(12) United States Patent
Sherley et al.

(10) Patent No.: US 7,867,712 B2
(45) Date of Patent: Jan. 11, 2011

(54) NUCLEIC ACID SEQUENCES ASSOCIATED WITH CELL STATES

(75) Inventors: James L. Sherley, Boston, MA (US); Min-Soo Noh, Seoul (KR)

(73) Assignee: Massachusetts Institute of Technology, Cambridge, MA (US)

( * ) Notice: Subject to any disclaimer, the term of this patent is extended or adjusted under 35 U.S.C. 154(b) by 225 days.

(21) Appl. No.: 12/063,182

(22) PCT Filed: Aug. 8, 2006

(86) PCT No.: PCT/US2006/030887

§ 371 (c)(1),
(2), (4) Date: Apr. 7, 2008

(87) PCT Pub. No.: WO2007/019499

PCT Pub. Date: Feb. 15, 2007

(65) Prior Publication Data

US 2009/0142760 A1 Jun. 4, 2009

Related U.S. Application Data

(60) Provisional application No. 60/706,366, filed on Aug. 8, 2005.

(51) Int. Cl.
*C12Q 1/68* (2006.01)
*G01N 33/53* (2006.01)
*C12P 19/34* (2006.01)

(52) U.S. Cl. .................... 435/6; 435/7.1; 435/91.2

(58) Field of Classification Search .................. None
See application file for complete search history.

(56) References Cited

U.S. PATENT DOCUMENTS

| | | |
|---|---|---|
| 2003/0133918 A1 | 7/2003 | Sherley |
| 2004/0018620 A1 | 1/2004 | Sherley et al. |
| 2005/0074874 A1 | 4/2005 | Sherley et al. |
| 2005/0272147 A1 | 12/2005 | Sherley et al. |
| 2007/0020610 A1 | 1/2007 | Sherley et al. |

OTHER PUBLICATIONS

Ivanova et al., "A Stem Cell Molecular Signature" Science (2002) vol. 298, pp. 601-604.
Ramalho-Santos et al., ""Stemness": Transcriptional Profiling of Embryonic and Adult Stem Cells" Science (2002) vol. 298, pp. 597-600.
Bhat, Krishna M. and Nora Apsel, "Upregulation of Mitimere and Nubbin acts through Cyclin E to confer self-renewing asymmetric division potential to neural precursor cells" Development (2004) vol. 131 No. 5, pp. 1123-1134.
Fortunel et al., "Comment on "Sternness": Transcriptional Profiling of Embryonic and Adult Stem Cells" and "A Stem Cell Molecular Signature" (I) Science (2003) vol. 302 p. 393 (3 pgs.).
Rick Lewis, "From Parts List to Architecture" The Scientist (2004) vol. 18 No. 16 pp. 24-24 (8 pgs.).

*Primary Examiner*—James Martinell
(74) *Attorney, Agent, or Firm*—Nixon Peabody LLP

(57) ABSTRACT

The present invention is directed to nucleic acid sequences whose expression is associated with different cell states, including nucleic acid sequences whose expression is induced at least 100-fold, or alternatively upregulated, in cells exhibiting asymmetric self-renewal relative to other cells. The invention is also directed to nucleic acid sequences whose expression is induced at least 100-fold, or alternatively upregulated, in cells exhibiting symmetric self-renewal relative to other cells.

13 Claims, 9 Drawing Sheets

Exclusively expressed genes

| Asymmetric Self-Renewal | Symmetric Self-Renewal |
|---|---|
| Mm.34446 (12575), p21 | Mm.7089 (17984), Necdin (Ndn) |
| Mm.23567 (93695), Glycoprotein nmb (Gpnmb) | Mm.41580 (69908), Rab3b, Ras oncogene family |
| Mm.80 (11576), Alpha-fetoprotein (Afp) | Mm.3063 (19242), Pleiotrophin |
| Mm.2902 (19275), Tyrosine phosphatase, N (Ptprn) | Mm.10681 (50706), Osteoblast specific factor 2 |
| Mm.1480 (13848), Eph receptor B6 (Ephb6) | Mm.33263 (14964), Histocompatibility 2, D, 1 |
| Mm.3390 (17912), Myosin 1b | Mm.102756 (171170), CHCR |
| Mm.32991 (171095), Interleukin 17 receptor-like (Il17rl) | Mm.41787 (56520), Nucleoside diphosphate kinase |
| Mm.40124 (23984), Phosphodiesterase 10A (Pde10a) | Mm.34797 (12903), Crabp1 |
| Mm.103351 (27403), ATP-binding cassette (Abca1) | Mm.33484 (112407), EGL nine homolog 3 (Egln3) |
| Mm.27646 (23972), Atpsk2 | Mm.1977 (13837), Mek4 |
| Mm.4851 (13805), CD105 | Mm.42040 (11639), Adenylate kinase 4 (Ak4) |
| 140 total probe sets | 62 total probe sets |

Genes were listed based on the rank which was determined from the averaged G-COS® normalized intensities from "present" calls

Differentially Expressed Genes

| Up-regulation in asymmetric self-renewal | Down-regulation in asymmetric self-renewal |
|---|---|
| Mm.2662 (14860), Glutathione S-transferase (Gsta4) | Mm.8473 (11529), Alcohol dehydrogenase 3 (Adh3) |
| Mm.178 (12955), Crystallin, alpha B (Cryab) | Mm.3460 (12475), CD14 |
| Mm.2103 (12450), Cyclin G | Mm.144089 (18591), PDGFb |
| Mm.29189 (11603), Adenylate kinase 1 (Ak1) | Mm.26817, HNK-1 sulfotransferase |
| Mm.16831 (12709), Creatine kinase, brain | Mm.26069 (22042), Transferrin receptor (Trfr) |
| Mm.4913 (14313), Follistatin (Fst) | Mm.2952 (14156), Flap specific endonuclease 1 |
| Mm.903 (12227), BTG-2 | Mm.121878 (22003), Tropomyosin 1, alpha |
| Mm.23776 (56742), Dda3-pending | Mm.916 (51788), H2A histone family, member Z |
| Mm.17980 (15368), Heme oxygenase (Hmox1) | Mm.340 (15354), HMGB3 |
| 97 total probe sets | 36 total probe sets |

Genes were listed based on the rank which was determined from the averaged ratio values of asymmetric to symmetric G-COS® normalized intensities

FIG. 5

NUCLEIC ACID SEQUENCES ASSOCIATED WITH CELL STATES

CROSS-REFERENCED APPLICATIONS

This application is a 371 National Stage Entry Application of co-pending International Application PCT/US2006/030887 filed Aug. 8, 2006, which designated the U.S. and claims the benefit under 35 U.S.C. §119(e) of U.S. Provisional Patent Application No. 60/706,366 filed Aug. 8, 2005.

GOVERNMENT SUPPORT

This invention was made with Government support under PSO HG 003170-02 awarded by the N.I.H.-N.H.G.R.I. and N.I.H.-N.I.E.H.S. C.E.H.S. pilot grant. The Government has certain rights in the invention.

FIELD OF THE INVENTION

The present application is directed to our identification of certain groupings of nucleic acid sequences associated with different cell states, including asymmetric self-renewal associated genes and symmetric self-renewal associated genes. The invention provides methods of using such nucleic acid sequences, including methods to identify cells displaying asymmetric self-renewal (ASR), stem cells, stem cell specific markers, methods to identify and enumerate ASR cells, stem cells, as well as methods of using such nucleic acids.

BACKGROUND OF THE INVENTION

Considerable attention has focused on stem cells such as embryonic stem cells and non-embryonic stem cells, and their uses in a range of therapies. The availability of stem cells from non-embryonic tissues can greatly contribute to cell replacement therapies such as bone marrow transplants, gene therapies, tissue engineering, and in vitro organogenesis. Production of autologous stem cells to replace injured tissue would also reduce the need for immune suppression interventions. Beyond their potential therapeutic applications, homogenous preparations of, for example, adult stem cells would have another important benefit, the ability to study their molecular and biochemical properties.

The existence of stem cells in somatic tissues is well established by functional tissue cell transplantation assays (Reisner et al., 1978). However, their individual identification has been difficult to accomplish. Even though their numbers have been enriched by methods such as immuno-selection with specific antibodies, there are no known markers that uniquely identify stem cells in somatic tissues (Merok and Sherley, 2001). Secondly, adult stem cells are often present in only minute quantities, are difficult to isolate and purify, and their numbers may decrease with age.

Mammalian adult stem cells replicate by asymmetric self-renewal to replenish cells in tissues that undergo cell turnover but maintain a constant cell mass (J. L. Sherley, Stem Cells 20, 561 (2002); M. Loeffler, C. S. Potten, in Stem Cells (ed, Potten, C. S.) 1-27 (Academic Press, London, 1997)). Each asymmetric adult stem cell division yields a new stem cell and a non-stem cell sister. The non-stem cell sister becomes the progenitor of the differentiated cells responsible for mature tissue functions (Loeffler, 1997; Sherley, 2002). In contrast, embryonic stem cells exhibit symmetric self-renewal (Stead E, et al., Oncogene 21(54):8320-33 (2002); Savatier P, et al., Oncogene (3):809-18 (1994)).

Cells display a range of expression states at certain times or in response to environmental stimuli, e.g. from resting to replicating. Recently attention has focused on identifying gene patterns, including mRNA patterns and protein expression patterns, connected with such different states. This is sometimes referred to as gene profiling—where transcriptomes associated with a specific state are identified. Being able to identify certain genes (and/or associated proteins and/or transcripts) that are associated with a cell being in a specific state permits one to readily identify and screen for specific cells, even from a population of related cells.

Thus, despite the need for methods to identify and isolate specific cells from an individual, it has not been possible to readily do so. Accordingly, it would be desirable to have a method to identify markers associated with different cells and/or different cells states in mammalian tissues.

SUMMARY OF THE INVENTION

We have now discovered groupings of nucleic acid sequences and corresponding proteins whose expression is associated with different cell states.

One embodiment of the invention is directed to nucleic acid sequences whose expression is changed by at least 100-fold in cells exhibiting asymmetric self-renewal relative to isogenic cells not undergoing such replication, as measured using a nucleic acid array. In one embodiment, the change in expression is measured using Affymetrix™ nucleic acid technology. Preferably, the change is an induction, one can also look for suppression—i.e., a decrease in expression.

One embodiment provides a gene expression profile associated with asymmetric self-renewal comprising an at least 100 fold increase in expression level relative to isogenic cells not undergoing asymmetric replication of at least five nucleic acid sequences, preferably at least ten nucleic acid sequences, selected from the group of Table 1, SEQ ID NOs: 1-141. In one embodiment, the cells are human cells and at least one of the nucleic acid sequences is selected from the group consisting AF308602; AI264121; AU160041; AL136573; NM_017585; AF047004; AL136566; NM_005545; AF327066; U73531; BC016797; BE781857; NM_024660; NM_019099; AL133001; NM_024587; AI954412; AI393309; NM_030581; and NM_017585. In one embodiment, the cells are murine cells and at least one of the nucleic acids is selected from the group consisting of NM_008714; BB559706; AK005731; BB131106; BB196807; BI217574; and BC024599, NM_012043; NM_008026; NM_030712; BF457736; BE981473; BB009770; BB049759; AU020235; BC019937; BC026495; AW259452; BB215355; and BB196807.

One embodiment of the invention provides identifying nucleic acid sequences whose expression is induced by at least 100-fold in cells exhibiting symmetric self-renewal relative to other cells. One embodiment provides a gene expression profile associated with symmetric self-renewal comprising at least five nucleic acid sequences, preferably at least ten nucleic acid sequences, selected from the group of Table 2, SEQ ID NOs: 142-215.

One embodiment of the invention provides identifying nucleic acid sequences whose expression is upregulated in cells exhibiting asymmetric self-renewal relative to other cells. One embodiment provides a gene expression profile associated with asymmetric self-renewal comprising at least five nucleic acid sequences, preferably at least ten nucleic acid sequences, selected from the group of Table 3, SEQ ID NOs: 216-418.

One embodiment of the invention provides identifying nucleic acid sequences whose expression is upregulated in cells exhibiting symmetric self-renewal, as compared to cells exhibiting asymmetric self-renewal. One embodiment provides a gene expression profile associated with symmetric self-renewal comprising at least five nucleic acid sequences, preferably at least ten nucleic acid sequences, selected from the group of Table 4, SEQ ID NOs: 419-604.

The nucleic acid sequences of the invention may be used as markers for cells exhibiting different cell states. In one embodiment, expression of at least 5, preferably at least 10, of the nucleic acid sequences of Table 1, SEQ ID NOs: 1-141, is indicative of asymmetrically self-renewing cells.

One embodiment of the invention provides for identifying a cell exhibiting symmetric self-renewal comprising detecting or measuring expression of five or more of the nucleic acid sequences selected from the group consisting of SEQ ID NOs: 605-624, wherein an at least 100 fold change in expression level expression relative to isogenic cells not undergoing asymmetric replication of five or more of said nucleic acids is indicative of a cell exhibiting symmetric self-renewal, and wherein said expression level is measured using a nucleic acid array. In one embodiment, the change in expression level is an at least 100 fold increase in expression level. In one embodiment, one measures expression of at least 10 of said nucleic acid sequences.

BRIEF DESCRIPTION OF THE DRAWINGS

FIG. 5 shows representative results of genes exclusively expressed in cells with asymmetric self-renewal, exclusively expressed in cells with symmetric self-renewal, genes differentially expressed in cells with asymmetric self-renewal, and genes differentially expressed in cells with symmetric self-renewal.

DETAILED DESCRIPTION OF THE INVENTION

We have now discovered groups of nucleic acid sequences associated with different cell states. Accordingly, the present invention is directed to gene groups and methods of using the gene groups to identify cells in different cell states, including asymmetric self-renewal and symmetric self-renewal.

Figure 1:
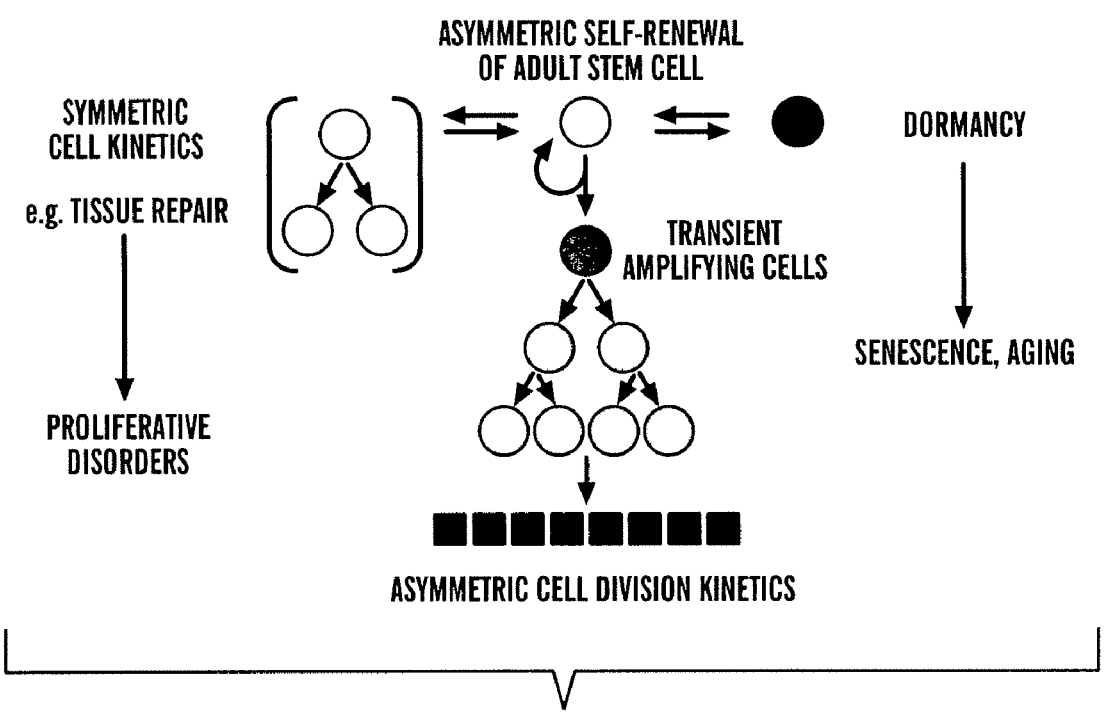
FIG. 1 is a schematic that shows asymmetric self-renewal kinetics of adult stem cells.

Asymmetric self-renewal (ASR, sometimes referred to as asymmetric replication) is illustrated in FIG. 1 (J. L. Sherley, Stem Cells 20, 561 (2002); M. Loeffler, C. S. Potten, in Stem Cells (ed, Potten, C. S.) 1-27 (Academic Press, London, 1997)). Mammalian adult stem cells display ASR and use ASR to replenish cells in tissues that undergo cell turnover but maintain a constant cell mass (Loeffler, 1997; Sherley, 2002). Each asymmetric adult stem cell division yields a new stem cell and a non-stem cell sister (i.e. a differentiated as opposed to pluripotent cell). The non-stem cell sister becomes the progenitor of the differentiated cells responsible for mature tissue functions (Loeffler, 1997; Sherley, 2002).

Symmetric self renewal is a general property of established cell lines in culture. Shifts from asymmetric self-renewal to symmetric self-renewal occur during adult maturation, wound repair, and in precancerous cells (see FIG. 1). Additionally, embryonic stem cells exhibit symmetric self-renewal (Stead E, et al., Oncogene 21(54):8320-33 (2002); Savatier P, et al., Oncogene (3):809-18 (1994)).

Because asymmetric self-renewal is associated with non-embryonic stem cells, genes whose expression profiles are associated with asymmetric self-renewal are useful to identify such stem cells.

Figure 2:
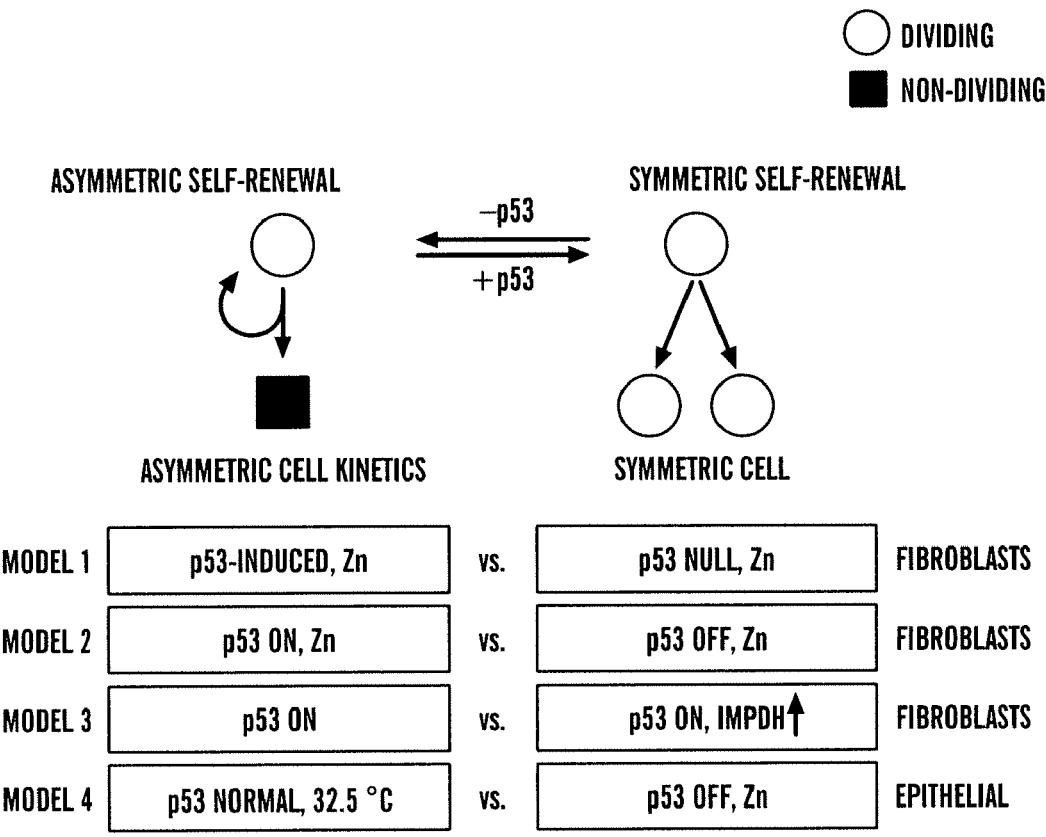
FIG. 2 is a schematic that shows cell culture model systems which conditionally exhibit asymmetric self-renewal or symmetric self-renewal. Essential features of the model cell lines for studying asymmetric self-renewal include 1) reversible regulation of self-renewal symmetry by p53 expression, and 2) non-random chromosome co-segregation. Four different models are shown.
Figure 3:
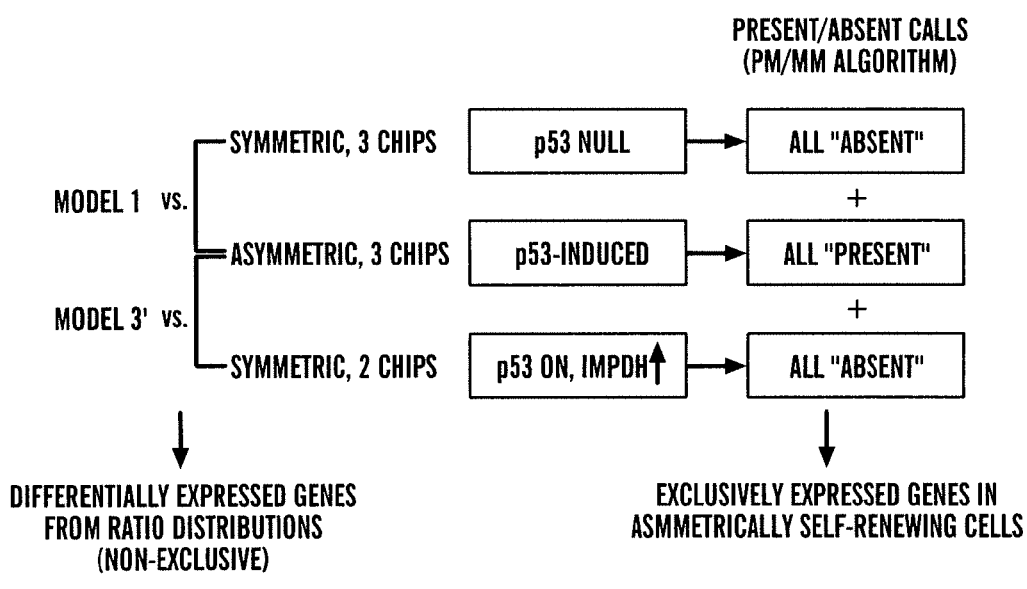
FIG. 3 is a schematic that shows the experimental design for the Affymetrix GeneChip™ analysis.

The present invention takes advantage of cell lines which model asymmetric and symmetric self-renewal, as illustrated in FIGS. 2 and 3. One regulator of asymmetric self-renewal is the p53 tumor suppressor protein. Several stable cultured murine cell lines have been derived that exhibit asymmetric self-renewal in response to controlled expression of the wild-type murine p53 (FIG. 2). (Sherley, 1991; Sherley et al, 1995 A-B; Liu et al., 1998 A-B; Rambhatla et al., 2001).

Gene Expression Profiles

We have now discovered various nucleic acid sequences whose expression is associated with different cell states. These global changes in gene expression are also referred to as expression profiles. The expression profiles have been used to identify individual genes that are differentially expressed under one or more conditions. In addition, the present invention identifies groups of genes that are differentially expressed. As used herein, "gene groups" includes, but is not limited to, the specific genes identified by accession number herein, as well as related sequences, the mRNAs and associated proteins.

The present invention provides gene groups whose expression is associated either with cells expressing asymmetric self-renewal or symmetric self-renewal. The gene groups are further classified into genes expressed exclusively in cells exhibiting asymmetric self-renewal; genes whose expression is induced in cells exhibiting asymmetric self-renewal relative to other cells; genes expressed exclusively in cells exhibiting symmetric self-renewal; and genes whose expression is induced in cells exhibiting symmetric self-renewal relative to other cells. Thus, by looking at enhanced or reduced expression in genes relative to other cells or other replicating cells one can readily screen for and select cells from a population of similar cells that are undergoing ASR or symmetric self-renewal. The change in expression of genes relative to other cells can be at least 50-fold, at least 100-fold, at least 150-fold, at least 200 fold, or at least 250-fold.

One embodiment of the invention provides nucleic acid sequences whose expression is induced by at least 100-fold in cells exhibiting asymmetric self-renewal relative to other cells. One embodiment provides a gene expression profile associated with asymmetric self-renewal comprising at least five nucleic acid sequences selected from the group of Table 1, SEQ ID NOs: 1-141. Preferably, one looks for changes in at least ten genes from the group. As used herein, all combinations between 5 to all 141 members can be looked at, such as 15, 20, 25, 35, 50, 75, 100, 141, etc. Additionally, one can look at other indicators of gene expression such as mRNA or the expression of the encoded proteins. In one embodiment, the cells are human cells and at least one of the nucleic acid sequences is selected from the group consisting AF308602; AI264121; AU160041; AL136573; NM_017585; AF047004; AL136566; NM_005545; AF327066; U73531; BC016797; BE781857; NM_024660; NM_019099; AL133001; NM_024587; AI954412; AI393309; NM_030581; and NM_017585 (see Table 6). In one embodiment, the cells are murine cells and at least one of the nucleic acids is selected from the group consisting of NM_008714; BB559706; AK005731; BB131106; BB196807; BI217574; and BC024599, NM_012043; NM_008026; NM_030712; BF457736; BE981473; BB009770; BB049759; AU020235; BC019937; BC026495; AW259452; BB215355; and BB196807 (see Table 5).

One embodiment of the invention provides nucleic acid sequences whose expression induced in cells exhibiting symmetric self-renewal relative to other cells by at least 100-fold. One embodiment provides a gene expression profile associated with symmetric self-renewal comprising at least five nucleic acid sequences selected from the group of Table 2, SEQ ID NOs: 142-215. Preferably, one looks for changes in at least ten genes from the group. As used herein, all combinations between 5 to all 74 members can be looked at, such as 15, 20, 25, 35, 50, 74, etc. Additionally, one can look at other indicators of gene expression such as mRNA or the expression of the encoded proteins.

One embodiment of the invention provides nucleic acid sequences whose expression is upregulated in cells exhibiting asymmetric self-renewal relative to other cells. One embodiment provides a gene expression profile associated with asymmetric self-renewal comprising at least five nucleic acid sequences selected from the group of Table 3, SEQ ID NOs: 216-418. Preferably, one looks for changes in at least ten genes from the group. As used herein, all combinations between 5 to all 203 members can be looked at, such as 15, 20, 25, 35, 50, 75, 100, 150, 203, etc. Additionally, one can look at other indicators of gene expression such as mRNA or the expression of the encoded proteins.

One embodiment of the invention provides nucleic acid sequences whose expression is upregulated in cells exhibiting symmetric self-renewal, as compared to cells exhibiting asymmetric self-renewal. (This can be looked at as having decreased expression in cells exhibiting ASR relative to symmetric replication.) One embodiment provides a gene expression profile associated with symmetric self-renewal comprising at least five nucleic acid sequences selected from the group of Table 4, SEQ ID NOs: 419-604. Preferably, one looks for changes in at least ten genes from the group. As used herein, all combinations between 5 to all 186 members can be looked at, such as 15, 20, 25, 35, 50, 75, 100, 150, 186, etc. Additionally, one can look at other indicators of gene expression such as mRNA or the expression of the encoded proteins.

One embodiment of the invention provides for identifying a cell exhibiting symmetric self-renewal comprising detecting or measuring expression of five or more of the nucleic acid sequences selected from the group consisting of SEQ ID NOs: 605-624, wherein an at least 100 fold change in expression level expression relative to isogenic cells not undergoing asymmetric replication of five or more of said nucleic acids is indicative of a cell exhibiting symmetric self-renewal, when said expression level is measured using a nucleic acid array. In one embodiment, the change in expression level is an at least 100 fold increase in expression level. In one embodiment, one measures expression of at least 10 of said nucleic acid sequences. As used herein, all combinations between 5 to all 20 members can be looked at, such as 5, 6, 7, 8, 9, 10, 11, 12, 13, 14, 15, 16, 17, 18, 19, and 20 members. Additionally, one can look at other indicators of gene expression such as mRNA or the expression of the encoded proteins and correlate the level of expression measured in such embodiment. In one embodiment, the combination measured does not include at least one of the sequences selected from the group consisting of SEQ ID NO: 605, SEQ ID NO: 606, SEQ ID NO: 607, and SEQ ID NO: 611.

The nucleic acid sequences and corresponding expressed proteins of the invention may be used as markers to identify cells exhibiting different cell states. For example, the nucleic acid sequences are useful for the development of cell state-specific molecular probes, as well as methods to identify desired cells in tissues and to isolate them directly from tissues. In one embodiment one can identify non-embryonic stem cells from a population of cells and isolate them by taking advantage of the correlation between cells exhibiting ASR and such stem cells.

In one embodiment, expression of any of the nucleic acid sequences of Table 1, SEQ ID NOs: 1-141, is indicative of asymmetrically self-renewing cells. Preferably, it is a grouping of at least five of those sequences. However, one can use any of five to all one hundred forty-one, such as 10, 15, 25, 50, 75, 90, 100, 141 and all combinations in between. In one embodiment one looks at the level of mRNAs. Alternatively, one looks at the expressed proteins. Expression of these nucleic acid sequences can be used to identify, detect, and quantify cells exhibiting asymmetric self-renewal, including non-embryonic stem cells.

One particularly preferred group of genes exclusively expressed in asymmetrically self-renewing cells is provided in Tables 5 and 6. For each Affy ID, determined as described in detail in the example below, Table 5 provides for the mouse genes the corresponding GenBank ID and gene name, as well as a description of the gene and the SEQ ID NO. used herein. Similarly, Table 6 provides for the human genes the corresponding GenBank ID and gene name, as well as a description of the gene and the SEQ ID NO. for the human gene.

In one embodiment, expression of any of the nucleic acid sequences of Table 2, SEQ ID NOs: 142-215, can be used to identify cells dividing with symmetric self-renewal. In one embodiment, these nucleic acid sequences are useful for discriminating between adult stem cell and their transient amplifying progeny. These nucleic acid sequences are also useful for identifying potential pre-cancerous and cancerous cells. These nucleic acid sequences are also useful as indicators of effective expansion of adult stem cells. Preferably, it is a grouping of at least five of those sequences. However, one can use any of five to all seventy-four, such as 10, 15, 25, 50, 74, and all combinations in between. In one embodiment one looks at the level of mRNAs. Alternatively, one looks at the expressed proteins.

In one embodiment, expression of any of the nucleic acid sequences of Table 3, SEQ ID NOs: 216-418, which are expressed in cells undergoing either asymmetric or symmetric self-renewal, but expressed at a higher level during asymmetric self-renewal, can be used to identify, detect, and quantify cells, including adult stem cells. Preferably, it is a grouping of at least five of those sequences. However, one can use any of five to all two hundred and three, such as 10, 15, 25, 50, 75, 90, 100, 150, 203, and all combinations in between. In one embodiment one looks at the level of mRNAs. Alternatively, one looks at the expressed proteins.

In one embodiment, expression of any of the nucleic acid sequences of Table 4, SEQ ID NOs: 419-604, can be used to identify cells dividing with symmetric self-renewal. In one embodiment, these nucleic acid sequences are useful for discriminating between adult stem cell and their transient amplifying progeny. These nucleic acid sequences are also useful for identifying potential pre-cancerous and cancerous cells. These nucleic acid sequences are also useful as indicators of effective expansion of adult stem cells. Preferably, it is a grouping of at least five of those sequences. However, one can use any of five to all one hundred eighty-six, such as 10, 15, 25, 50, 75, 90, 100, 150, 186, and all combinations in between. In one embodiment one looks at the level of mRNAs. Alternatively, one looks at the expressed proteins.

In one embodiment, the exemplary probes shown in the column "Affy ID" of Tables 1-6 can be used to detect expression of the nucleic acid sequences of the invention. The sequences of the individual probes of the Affymetrix Gene-Chip® 430 2.0 array are publicly available, including from Affymetrix, affymetrix.com/products/arrays/index.affx. Alternatively, any sequences which hybridize to those genes can be used. One can use chips from any commercial manufacturer to identify the expression levels.

Methods of Detection

The expression profiles have been used to identify individual genes that are differentially expressed under one or more conditions. In addition, the present invention identifies families of genes that are differentially expressed. As used herein, "gene families" includes, but is not limited to, the specific genes identified by accession number herein, as well as related sequences. Related sequences may be, for example, sequences having a high degree of sequence identity with a specifically identified sequence either at the nucleotide level or at the level of amino acids of the encoded polypeptide. A high degree of sequence identity is seen to be at least about 65% sequence identity at the nucleotide level to said genes, preferably about 80 or 85% sequence identity or more preferably about 90 or 95% or more sequence identity to said genes. With regard to amino acid identity of encoded polypeptides, a high degree of identity is seen to be at least about 50% identity, more preferably about 75% identity and most preferably about 85% or more sequence identity. In particular, related sequences include homologous genes from different organisms. For example, if the specifically identified gene is from a non-human mammal, the gene family would encompass homologous genes from other mammals including humans. If the specifically identified gene is a human gene, gene family would encompass the homologous gene from different organisms. Those skilled in the art will appreciate that a homologous gene may be of different length and may comprise regions with differing amounts of sequence identity to a specifically identified sequence.

The genes and sequences identified as being differentially expressed in the various cell populations described herein, as well as related sequences, may be used in a variety of nucleic acid detection assays to detect or quantitate the expression level of a gene or multiple genes in a given sample. For example, traditional Northern blotting, nuclease protection, RT-PCR, QPCR (quantitative RT-PCR), Taqman® and differential display methods may be used for detecting gene expression levels. Those methods are useful for some embodiments of the invention. However, methods and assays of the invention are most efficiently designed with hybridization-based methods for detecting the expression of a large number of genes.

The genes which are assayed according to the present invention are typically in the form of mRNA or reverse transcribed mRNA. The genes may be cloned or not. The genes may be amplified or not. In certain embodiments, it may be preferable to use polyadenylated RNA as a source, as it can be used with less processing steps.

Tables 1-8 provide the Accession numbers and name for the sequences of the differentially expressed markers (SEQ ID NOs: 1-624). The sequences of the genes in GenBank are expressly incorporated herein.

Table 9 provides an example showing the sequences for the sequences and GenBank ID accessions listed in Table 6.

Probes based on the sequences of the genes described above may be prepared by any commonly available method. Oligonucleotide probes for interrogating the tissue or cell sample are preferably of sufficient length to specifically hybridize only to appropriate, complementary genes or transcripts. Typically the oligonucleotide probes will be at least 10, 12, 14, 16, 18, 20 or 25 nucleotides in length. In some cases longer probes of at least 30, 40 or 50 nucleotides will be desirable.

As used herein, oligonucleotide sequences that are complementary to one or more of the genes and/or gene families described in Tables 1-8, refer to oligonucleotides that are capable of hybridizing under stringent conditions to at least part of the nucleotide sequences of said genes. Such hybridizable oligonucleotides will typically exhibit at least about 75% sequence identity at the nucleotide level to said genes, preferably about 80 or 85% sequence identity or more preferably about 90 or 95% or more sequence identity to said genes.

"Bind(s) substantially" refers to complementary hybridization between a probe nucleic acid and a target nucleic acid and embraces minor mismatches that can be accommodated by reducing the stringency of the hybridization media to achieve the desired detection of the target polynucleotide sequence.

The terms "background" or "background signal intensity" refer to hybridization signals resulting from non-specific binding, or other interactions, between the labeled target nucleic acids and components of the oligonucleotide array (e.g., the oligonucleotide probes, control probes, the array substrate, etc.). Background signals may also be produced by intrinsic fluorescence of the array components themselves. A single background signal can be calculated for the entire array, or a different background signal may be calculated for each target nucleic acid. In a preferred embodiment, background is calculated as the average hybridization signal intensity for the lowest 5 to 10% of the probes in the array, or, where a different background signal is calculated for each target gene, for the lowest 5 to 10% of the probes for each gene. Of course, one of skill in the art will appreciate that where the probes to a particular gene hybridize well and thus appear to be specifically binding to a target sequence, they should not be used in a background signal calculation. Alternatively, background may be calculated as the average hybridization signal intensity produced by hybridization to probes that are not complementary to any sequence found in the sample (e.g., probes directed to nucleic acids of the opposite sense or to genes not found in the sample such as bacterial genes where the sample is mammalian nucleic acids). Background can also be calculated as the average signal intensity produced by regions of the array that lack any probes at all.

The phrase "hybridizing specifically to" refers to the binding, duplexing, or hybridizing of a molecule substantially to or only to a particular nucleotide sequence or sequences under stringent conditions when that sequence is present in a complex mixture (e.g., total cellular) DNA or RNA.

Assays and methods of the invention may utilize available formats to simultaneously screen at least about 100, preferably about 1000, more preferably about 10,000 and most preferably about 100,000 different nucleic acid hybridizations.

The terms "mismatch control" or "mismatch probe" refer to a probe whose sequence is deliberately selected not to be perfectly complementary to a particular target sequence. For each mismatch (MM) control in a high-density array there typically exists a corresponding perfect match (PM) probe that is perfectly complementary to the same particular target sequence. The mismatch may comprise one or more bases.

While the mismatch(es) may be located anywhere in the mismatch probe, terminal mismatches are less desirable as a terminal mismatch is less likely to prevent hybridization of the target sequence. In a particularly preferred embodiment, the mismatch is located at or near the center of the probe such that the mismatch is most likely to destabilize the duplex with the target sequence under the test hybridization conditions.

The term "perfect match probe" refers to a probe that has a sequence that is perfectly complementary to a particular target sequence. The test probe is typically perfectly complementary to a portion (subsequence) of the target sequence. The perfect match (PM) probe can be a "test probe" or a "normalization control" probe, an expression level control probe and the like. A perfect match control or perfect match probe is, however, distinguished from a "mismatch control" or "mismatch probe" as defined herein.

As used herein a "probe" is defined as a nucleic acid, capable of binding to a target nucleic acid of complementary sequence through one or more types of chemical bonds, usually through complementary base pairing, usually through hydrogen bond formation. As used herein, a probe may include natural (i.e., A, G, U, C or T) or modified bases (7-deazaguanosine, inosine, PNAs, etc.). In addition, the bases in probes may be joined by a linkage other than a phosphodiester bond, so long as it does not interfere with hybridization. Thus, probes may be peptide nucleic acids in which the constituent bases are joined by peptide bonds rather than phosphodiester linkages.

The term "stringent conditions" refers to conditions under which a probe will hybridize to its target subsequence, but with only insubstantial hybridization to other sequences or to other sequences such that the difference may be identified. Stringent conditions are sequence-dependent and will be different in different circumstances. Longer sequences hybridize specifically at higher temperatures. Generally, stringent conditions are selected to be about 5.degree. C. lower than the thermal melting point (Tm) for the specific sequence at a defined ionic strength and pH.

Typically, stringent conditions will be those in which the salt concentration is at least about 0.01 to 1.0 M sodium ion concentration (or other salts) at pH 7.0 to 8.3 and the temperature is at least about 30.degree. C. for short probes (e.g., 10 to 50 nucleotides). Stringent conditions may also be achieved with the addition of destabilizing agents such as formamide.

The "percentage of sequence identity" or "sequence identity" is determined by comparing two optimally aligned sequences or subsequences over a comparison window or span, wherein the portion of the polynucleotide sequence in the comparison window may optionally comprise additions or deletions (i.e., gaps) as compared to the reference sequence (which does not comprise additions or deletions) for optimal alignment of the two sequences. The percentage is calculated by determining the number of positions at which the identical residue (e.g., nucleic acid base or amino acid residue) occurs in both sequences to yield the number of matched positions, dividing the number of matched positions by the total number of positions in the window of comparison and multiplying the result by 100 to yield the percentage of sequence identity.

Percentage sequence identity can be calculated by the local homology algorithm of Smith & Waterman, (1981) Adv. Appl. Math. 2:482-485; by the homology alignment algorithm of Needleman & Wunsch, (1970) J. Mol. Biol. 48:443-445; or by computerized implementations of these algorithms (GAP & BESTFIT in the GCG Wisconsin Software Package, Genetics Computer Group) or by manual alignment and visual inspection.

Percentage sequence identity when calculated using the programs GAP or BESTFIT is calculated using default gap weights. The BESTFIT program has two alignment variables, the gap creation penalty and the gap extension penalty, which can be modified to alter the stringency of a nucleotide and/or amino acid alignment produced by the program. Parameter values used in the percent identity determination were default values previously established for version 8.0 of BESTFIT (see Dayhoff, (1979) Atlas of Protein Sequence and Structure, National Biomedical Research Foundation, pp. 353-358).

As is apparent to one of ordinary skill in the art, nucleic acid samples, which may be DNA and/or RNA, used in the methods and assays of the invention may be prepared by any available method or process. Methods of isolating total mRNA are well known to those of skill in the art. For example, methods of isolation and purification of nucleic acids are described in detail in Chapter 3 of Tijssen, (1993) Laboratory Techniques in Biochemistry and Molecular Biology: Hybridization With Nucleic Acid Probes, Elsevier Press. Such samples include RNA samples, but also include cDNA synthesized from a mRNA sample isolated from a cell or tissue of interest. Such samples also include DNA amplified from the cDNA, and RNA transcribed from the amplified DNA. One of skill in the art would appreciate that it is desirable to inhibit or destroy RNase present in homogenates before homogenates can be used.

Biological samples may be of any biological tissue or fluid or cells from any organism as well as cells raised in vitro, such as cell lines and tissue culture cells. Frequently, the sample will be a "clinical sample" which is a sample derived from a patient. Typical clinical samples include, but are not limited to, sputum, blood, blood-cells (e.g., white cells), tissue or fine needle biopsy samples, urine, peritoneal fluid, and pleural fluid, or cells therefrom. Biological samples may also include sections of tissues, such as frozen sections or formalin fixed sections taken for histological purposes.

In certain embodiments, the term "individual", as used herein, preferably refers to human. However, the methods are not limited to humans, and a skilled artisan can use the diagnostic/prognostic gene groupings of the present invention in, for example, laboratory test animals, including but not limited to rats and mice, dogs, sheep, pig, guinea pigs, and other model animals.

The phrase "altered expression" as used herein, refers to either increased or decreased expression in a cell. The terms "upregulation" and "downregulation" refers to the amount of expression in a first cell or population of cells relative to the amount of expression in a second cell or population of cells.

The analysis of the gene expression of one or more gene groups of the present invention can be performed using any gene expression method known to one skilled in the art. Such methods include, but are not limited to, expression analysis using nucleic acid chips (e.g. Affymetrix chips) and quantitative RT-PCR based methods using, for example real-time detection of the transcripts. Analysis of transcript levels according to the present invention can be made using total or messenger RNA or proteins encoded by the genes identified in the diagnostic gene groups of the present invention as a starting material. In one embodiment the analysis is an immunohistochemical analysis with an antibody directed against proteins comprising at least 5 proteins encoded by the genes of expression group being analyzed The methods of analyzing transcript levels of the gene groups in an individual include Northern-blot hybridization, ribonuclease protection assay, and reverse transcriptase polymerase chain reaction (RT-PCR) based methods. The different RT-PCR based techniques are the most suitable quantification method for certain applications of the present invention, because they are very sensitive and thus require only a small sample size which is desirable for a diagnostic test. A number of quantitative RT-PCR based methods have been described and are useful in measuring the amount of transcripts according to the present invention. These methods include RNA quantification using PCR and complementary DNA (cDNA) arrays (Shalon et al., Genome Research 6(7): 639-45, 1996; Bernard et al., Nucleic Acids Research 24(8): 1435-42, 1996), real competitive PCR using a MALDI-TOF Mass spectrometry based approach (Ding et al, PNAS, 100: 3059-64, 2003), solid-phase mini-sequencing technique, which is based upon a primer extension reaction (U.S. Pat. No. 6,013,431, Suomalainen et al. Mol. Biotechnol. June; 15(2):123-31, 2000), ion-pair high-performance liquid chromatography (Doris et al. J. Chromatogr. A May 8; 806(1):47-60, 1998), and 5' nuclease assay or real-time RT-PCR (Holland et al. Proc Natl Acad Sci USA 88: 7276-7280, 1991).

Methods using RT-PCR and internal standards differing by length or restriction endonuclease site from the desired target sequence allowing comparison of the standard with the target using gel electrophoretic separation methods followed by densitometric quantification of the target have also been developed and can be used to detect the amount of the transcripts according to the present invention (see, e.g., U.S. Pat. Nos. 5,876,978; 5,643,765; and 5,639,606.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series (Vols. I-IV)*, *Using Antibodies: A Laboratory Manual*, *Cells: A Laboratory Manual*, *PCR Primer: A Laboratory Manual*, and *Molecular Cloning: A Laboratory Manual* (all from Cold Spring Harbor Laboratory Press), Stryer, L. (1995) *Biochemistry* (4th Ed.) Freeman, New York, Gait, "Oligonucleotide Synthesis: A Practical Approach" 1984, IRL Press, London, Nelson and Cox (2000), Lehninger, *Principles of Biochemistry* $3^{rd}$ Ed., W.H. Freeman Pub., New York, N.Y. and Berg et al. (2002) *Biochemistry*, $5^{th}$ Ed., W.H. Freeman Pub., New York, N.Y., all of which are herein incorporated in their entirety by reference for all purposes.

The methods of the present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242, 974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication Number WO 99/36760) and PCT/US01/04285, which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide and protein arrays.

Nucleic acid arrays that are useful in the present invention include, but are not limited to those that are commercially available from Affymetrix (Santa Clara, Calif.) under the brand name GeneChip7. Example arrays are shown on the website at affymetrix.com One of skill in the art will appreciate that an enormous number of array designs are suitable for the practice of this invention. In some preferred embodiments, a high density array may be used. The high density array will typically include a number of probes that specifically hybridize to the sequences of interest (see WO 99/32660 for methods of producing probes for a given gene or genes). In addition, in a preferred embodiment, the array will include one or more control probes.

High density array chips of the invention include "test probes" as defined herein. Test probes could be oligonucleotides that range from about 5 to about 45 or 5 to about 500 nucleotides, more preferably from about 10 to about 40 nucleotides and most preferably from about 15 to about 40 nucleotides in length. In other particularly preferred embodiments, the probes are 20 or 25 nucleotides in length. In another preferred embodiment, test probes are double or single strand nucleic acid sequences, preferably DNA sequences. Nucleic acid sequences may be isolated or cloned from natural sources or amplified from natural sources using native nucleic acid as templates. These probes have sequences complementary to particular subsequences of the genes whose expression they are designed to detect. Thus, the test probes are capable of specifically hybridizing to the target nucleic acid they are to detect.

In addition to test probes that bind the target nucleic acid(s) of interest, the high density array can contain a number of control probes. The control probes fall into three categories referred to herein as (1) normalization controls; (2) expression level controls; and (3) mismatch controls.

Normalization controls are oligonucleotide or other nucleic acid probes that are complementary to labeled reference oligonucleotides or other nucleic acid sequences that are added to the nucleic acid sample to be screened. The signals obtained from the normalization controls after hybridization provide a control for variations in hybridization conditions, label intensity, "reading" efficiency and other factors that may cause the signal of a perfect hybridization to vary between arrays. In a preferred embodiment, signals (e.g., fluorescence intensity) read from all other probes in the array are divided by the signal (e.g., fluorescence intensity) from the control probes thereby normalizing the measurements.

Virtually any probe may serve as a normalization control. However, it is recognized that hybridization efficiency varies with base composition and probe length. Preferred normalization probes are selected to reflect the average length of the other probes present in the array, however, they can be selected to cover a range of lengths. The normalization control(s) can also be selected to reflect the (average) base composition of the other probes in the array, however in a preferred embodiment, only one or a few probes are used and they are selected such that they hybridize well (i.e., no secondary structure) and do not match any target-specific probes.

Expression level controls are probes that hybridize specifically with constitutively expressed genes in the biological sample. Virtually any constitutively expressed gene provides a suitable target for expression level controls. Typically expression level control probes have sequences complementary to subsequences of constitutively expressed "housekeeping genes" including, but not limited to the actin gene, the transferrin receptor gene, the GAPDH gene, and the like.

Mismatch controls may also be provided for the probes to the target genes, for expression level controls or for normalization controls. Mismatch controls are oligonucleotide probes or other nucleic acid probes identical to their corresponding test or control probes except for the presence of one or more mismatched bases. A mismatched base is a base selected so that it is not complementary to the corresponding base in the target sequence to which the probe would otherwise specifically hybridize. One or more mismatches are selected such that under appropriate hybridization conditions (e.g., stringent conditions) the test or control probe would be expected to hybridize with its target sequence, but the mismatch probe would not hybridize (or would hybridize to a significantly lesser extent). Preferred mismatch probes contain a central mismatch. Thus, for example, where a probe is a twenty-mer, a corresponding mismatch probe will have the identical sequence except for a single base mismatch (e.g., substituting a G, C or T for an A) at any of positions six through fourteen (the central mismatch).

Mismatch probes thus provide a control for non-specific binding or cross hybridization to a nucleic acid in the sample other than the target to which the probe is directed. Mismatch probes also indicate whether a hybridization is specific or not.

For example, if the target is present the perfect match probes should be consistently brighter than the mismatch probes. In addition, if all central mismatches are present, the mismatch probes can be used to detect a mutation. The difference in intensity between the perfect match and the mismatch probe provides a good measure of the concentration of the hybridized material.

The present invention also contemplates many uses for polymers attached to solid substrates. These uses include gene expression monitoring, profiling, library screening, genotyping and diagnostics. Examples of gene expression monitoring, and profiling methods are shown in U.S. Pat. Nos. 5,800,992, 6,013,449, 6,020,135, 6,033,860, 6,040,138, 6,177,248 and 6,309,822. Examples of genotyping and uses therefore are shown in U.S. Ser. No. 60/319,253, 10/013,598, and U.S. Pat. Nos. 5,856,092, 6,300,063, 5,858,659, 6,284, 460, 6,361,947, 6,368,799 and 6,333,179. Other examples of uses are embodied in U.S. Pat. Nos. 5,871,928, 5,902,723, 6,045,996, 5,541,061, and 6,197,506.

The present invention also contemplates sample preparation methods in certain preferred embodiments. Prior to or concurrent with expression analysis, the nucleic acid sample may be amplified by a variety of mechanisms, some of which may employ PCR. See, e.g., *PCR Technology: Principles and Applications for DNA Amplification* (Ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); PCR (Eds. McPherson et al., IRL Press, Oxford); and U.S. Pat. Nos. 4,683,202, 4,683,195, 4,800,159 4,965, 188, and 5,333,675, and each of which is incorporated herein by reference in their entireties for all purposes. The sample may be amplified on the array. See, for example, U.S. Pat. No. 6,300,070 and U.S. patent application Ser. No. 09/513,300, which are incorporated herein by reference.

Other suitable amplification methods include the ligase chain reaction (LCR) (e.g., Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA,* 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242, 794, 5,494,810, 4,988,617 and in U.S. Ser. No. 09/854,317, each of which is incorporated herein by reference.

Additional methods of sample preparation and techniques for reducing the complexity of a nucleic sample are described, for example, in Dong et al., *Genome Research* 11, 1418 (2001), in U.S. Pat. Nos. 6,361,947, 6,391,592 and U.S. patent application Ser. Nos. 09/916,135, 09/920,491, 09/910, 292, and 10/013,598.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* ($2^{nd}$ Ed. Cold Spring Harbor, N.Y, 1989); Berger and Kimmel *Methods in Enzymology*, Vol. 152, *Guide to Molecular Cloning Techniques* (Academic Press, Inc., San Diego, Calif., 1987); Young and Davism, *P.N.A.S,* 80: 1194 (1983). Methods and apparatus for carrying out repeated and controlled hybridization reactions have been described, for example, in U.S. Pat. Nos. 5,871,928, 5,874,219, 6,045,996 and 6,386, 749, 6,391,623 each of which are incorporated herein by reference.

The present invention also contemplates signal detection of hybridization between ligands in certain preferred embodiments. See, for example, U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in provisional U.S. Patent application 60/364,731 and in PCT Application PCT/US99/06097 (published as WO99/47964), each of which also is hereby incorporated by reference in its entirety for all purposes.

Examples of methods and apparatus for signal detection and processing of intensity data are disclosed in, for example, U.S. Pat. Nos. 5,143,854, 5,547,839, 5,578,832, 5,631,734, 5,800,992, 5,834,758; 5,856,092, 5,902,723, 5,936,324, 5,981,956, 6,025,601, 6,090,555, 6,141,096, 6,185,030, 6,201,639; 6,218,803; and 6,225,625, in U.S. Patent application 60/364,731 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, e.g. Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis *Bioinforinatics: A Practical Guide for Analysis of Gene and Proteins* (Wiley & Sons, Inc., $2^{nd}$ ed., 2001).

The present invention also makes use of various computer program products and software for a variety of purposes, such as probe design, management of data, analysis, and instrument operation. See, for example, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.

Additionally, the present invention may have preferred embodiments that include methods for providing genetic information over networks such as the Internet as shown in, for example, U.S. patent application Ser. Nos. 10/063,559, 60/349,546, 60/376,003, 60/394,574, 60/403,381.

Throughout this specification, various aspects of this invention are presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The present invention has many preferred embodiments and relies on many patents, applications and other references for details known to those of the art. Therefore, when a patent, application, or other reference is cited or repeated throughout the specification, it should be understood that it is incorporated by reference in its entirety for all purposes as well as for the proposition that is recited.

In one preferred embodiment, the invention provides a prognostic and/or diagnostic immunohistochemical approach, such as a dip-stick analysis, to determine the presence of adult stem cells. Antibodies against proteins, or antigenic epitopes thereof, that are encoded by the group of genes of the present invention, are either commercially available or can be produced using methods well know to one skilled in the art. The invention contemplates either one dipstick capable of detecting all the diagnostically important gene products or alternatively, a series of dipsticks capable of detecting the amount proteins of a smaller sub-group of diagnostic proteins of the present invention.

Antibodies can be prepared by means well known in the art. The term "antibodies" is meant to include monoclonal antibodies, polyclonal antibodies and antibodies prepared by recombinant nucleic acid techniques that are selectively reactive with a desired antigen. Antibodies against the proteins encoded by any of the genes in the diagnostic gene groups of the present invention are either known or can be easily produced using the methods well known in the art. Internet sites such as Biocompare at http://www.biocompare.com/abmatrix.asp?antibody=y provide a useful tool to anyone skilled in the art to locate existing antibodies against any of the proteins provided according to the present invention.

Antibodies against the proteins according to the present invention can be used in standard techniques such as Western blotting or immunohistochemistry to quantify the level of expression of the proteins corresponding to the gene group of interest. Immunohistochemical applications include assays, wherein increased presence of the protein can be assessed, for example, from a biological sample.

The immunohistochemical assays according to the present invention can be performed using methods utilizing solid supports. The solid support can be any phase used in performing immunoassays, including dipsticks, membranes, absorptive pads, beads, microtiter wells, test tubes, and the like. The preparation and use of such conventional test systems is well described in the patent, medical, and scientific literature. If a stick is used, the anti-protein antibody is bound to one end of the stick such that the end with the antibody can be dipped into the solutions as described below for the detection of the protein. Alternatively, the samples can be applied onto the antibody-coated dipstick or membrane by pipette or dropper or the like.

The antibody against proteins encoded by the genes of interest (the "protein") can be of any isotype, such as IgA, IgG or IgM, Fab fragments, or the like. The antibody may be a monoclonal or polyclonal and produced by methods as generally described, for example, in Harlow and Lane, Antibodies, A Laboratory Manual, Cold Spring Harbor Laboratory, 1988, incorporated herein by reference. The antibody can be applied to the solid support by direct or indirect means. Indirect bonding allows maximum exposure of the protein binding sites to the assay solutions since the sites are not themselves used for binding to the support. Preferably, polyclonal antibodies are used since polyclonal antibodies can recognize different epitopes of the protein thereby enhancing the sensitivity of the assay.

The solid support is preferably non-specifically blocked after binding the protein antibodies to the solid support. Non-specific blocking of surrounding areas can be with whole or derivatized bovine serum albumin, or albumin from other animals, whole animal serum, casein, non-fat milk, and the like.

The sample is applied onto the solid support with bound protein-specific antibody such that the protein will be bound to the solid support through said antibodies. Excess and unbound components of the sample are removed and the solid support is preferably washed so the antibody-antigen complexes are retained on the solid support. The solid support may be washed with a washing solution which may contain a detergent such as Tween-20, Tween-80 or sodium dodecyl sulfate.

After the protein has been allowed to bind to the solid support, a second antibody which reacts with protein is applied. The second antibody may be labeled, preferably with a visible label. The labels may be soluble or particulate and may include dyed immunoglobulin binding substances, simple dyes or dye polymers, dyed latex beads, dye-containing liposomes, dyed cells or organisms, or metallic, organic, inorganic, or dye solids. The labels may be bound to the protein antibodies by a variety of means that are well known in the art. In some embodiments of the present invention, the labels may be enzymes that can be coupled to a signal producing system. Examples of visible labels include alkaline phosphatase, beta-galactosidase, horseradish peroxidase, and biotin. Many enzyme-chromogen or enzyme-substrate-chromogen combinations are known and used for enzyme-linked assays. Dye labels also encompass radioactive labels and fluorescent dyes.

Simultaneously with the sample, corresponding steps may be carried out with a known amount or amounts of the protein and such a step can be the standard for the assay. A sample from a healthy individual exposed to a similar air pollutant such as cigarette smoke, can be used to create a standard for any and all of the diagnostic gene group encoded proteins.

The solid support is washed again to remove unbound labeled antibody and the labeled antibody is visualized and quantified. The accumulation of label will generally be assessed visually. This visual detection may allow for detection of different colors, for example, red color, yellow color, brown color, or green color, depending on label used. Accumulated label may also be detected by optical detection devices such as reflectance analyzers, video image analyzers and the like. The visible intensity of accumulated label could correlate with the concentration of protein in the sample. The correlation between the visible intensity of accumulated label and the amount of the protein may be made by comparison of the visible intensity to a set of reference standards. Preferably, the standards have been assayed in the same way as the unknown sample, and more preferably alongside the sample, either on the same or on a different solid support.

The assay reagents, pipettes/dropper, and test tubes may be provided in the form of a kit. Accordingly, the invention further provides a test kit for visual detection of the proteins encoded by the various gene groups. The test kit comprises one or more solutions containing a known concentration of one or more proteins encoded by the gene group of interest (the "protein") to serve as a standard; a solution of a anti-protein antibody bound to an enzyme; a chromogen which changes color or shade by the action of the enzyme; a solid support chosen from the group consisting of dip-stick and membrane carrying on the surface thereof an antibody to the protein. Instructions including the up or down regulation of the each of the genes in the groups as provided by the Tables 1-8 are included with the kit.

Somatic Stem Cells

As used herein, stem cells derived from or found in tissues other than from an embryo are sometimes referred to as non-embryonic stem cells, adult stem cells, somatic tissue stem cells, or somatic stem cells.

Any source of non-embryonic stem cells can be used in the methods of the present invention, including primary stem cells from an animal as well as model cell lines which exhibit asymmetric self-renewal.

The methods of the present invention can use these p53 model cells lines, as well as other cell lines which exhibit conditional asymmetric self-renewal.

Non-embryonic stem cells of the present invention include any stem cells isolated from adult tissue, including but are not limited to bone marrow derived stem cells, adipose derived stem cells, mesenchymal stem cells, neural stem cells, liver stem cells, and pancreatic stem cells. Bone marrow derived stem cells refers to all stem cells derived from bone marrow; these include but are not limited to mesenchymal stem cells, bone marrow stromal cells, and hematopoietic stem cells. Bone marrow stem cells are also known as mesenchymal stem cells or bone marrow stromal stem cells, or simply stromal cells or stem cells.

The stem cells are pluripotent and act as precursor cells, which produce daughter cells that mature into differentiated cells. In some embodiments, non-embryonic stem cells can be isolated from fresh bone marrow or adipose tissue by fractionation using fluorescence activated call sorting (FACS) with unique cell surface antigens to isolate specific subtypes of stem cells (such as bone marrow or adipose derived stem cells).

Bone marrow or adipose tissue derived stem cells may be obtained by removing bone marrow cells or fat cells, from a donor, either self or matched, and placing the cells in a sterile container. If the cells are adherent cells, the sterile container may include a plastic surface or other appropriate surface to which the cells adhere. For example, stromal cells will adhere to a plastic surface within 30 minutes to about 6 hours. After at least 30 minutes, preferably about four hours, the non-adhered cells may be removed and discarded. The adhered cells are stem cells, which are initially non-dividing. After about 2-4 days however the cells begin to proliferate.

Cells can be obtained from donor tissue by dissociation of individual cells from the connecting extracellular matrix of the tissue. Tissue is removed using a sterile procedure, and the cells are dissociated using any method known in the art including treatment with enzymes such as trypsin, collagenase, and the like, or by using physical methods of dissociation such as with a blunt instrument. Dissociation of cells can be carried out in any acceptable medium, including tissue culture medium. For example, a preferred medium for the dissociation of neural stem cells is low calcium artificial cerebrospinal fluid.

The dissociated stem cells or model cell lines can be cultured in any known culture medium capable of supporting cell growth, including HEM, DMEM, RPMI, F-12, and the like, containing supplements which are required for cellular metabolism such as glutamine and other amino acids, vitamins, minerals and useful proteins such as transferrin and the like. Medium may also contain antibiotics to prevent contamination with yeast, bacteria and fungi such as penicillin, streptomycin, gentamicin and the like. In some cases, the medium may contain serum derived from bovine, equine, chicken and the like. Serum can contain xanthine, hypoxanthine, or other compounds which enhance guanine nucleotide biosynthesis, although generally at levels below the effective concentration to suppress asymmetric cell kinetics. Thus, preferably a defined, serum-free culture medium is used, as serum contains unknown components (i.e. is undefined). Preferably, if serum is used, it has been dialyzed to remove guanine ribonucleotide precursors (rGNPrs). A defined culture medium is also preferred if the cells are to be used for transplantation purposes. A particularly preferable culture medium is a defined culture medium comprising a mixture of DMEM, F12, and a defined hormone and salt mixture.

The culture medium can be supplemented with a proliferation-inducing growth factor(s). As used herein, the term "growth factor" refers to a protein, peptide or other molecule having a growth, proliferative, differentiative, or trophic effect on neural stem cells and/or neural stem cell progeny. Growth factors that may be used include any trophic factor that allows stem cells to proliferate, including any molecule that binds to a receptor on the surface of the cell to exert a trophic, or growth-inducing effect on the cell. Preferred proliferation-inducing growth factors include EGF, amphiregulin, acidic fibroblast growth factor (aFGF or FGF-1), basic fibroblast growth factor (bFGF or FGF-2), transforming growth factor alpha (TGF.alpha.), and combinations thereof. Growth factors are usually added to the culture medium at concentrations ranging between about 1 fg/ml to 1 mg/ml. Concentrations between about 1 to 100 ng/ml are usually sufficient. Simple titration experiments can be easily performed to determine the optimal concentration of a particular growth factor.

In addition to proliferation-inducing growth factors, other growth factors may be added to the culture medium that influence proliferation and differentiation of the cells including NGF, platelet-derived growth factor (PDGF), thyrotropin releasing hormone (TRH), transforming growth factor betas (TGF.beta.s), insulin-like growth factor (IGF.sub.−1) and the like.

Stem cells can be cultured in suspension or on a fixed substrate. One particularly preferred substrate is a hydrogel, such as a peptide hydrogel, as described below. However, certain substrates tend to induce differentiation of certain stem cells. Thus, suspension cultures are preferable for such stem cell populations. Cell suspensions can be seeded in any receptacle capable of sustaining cells, particularly culture flasks, cultures plates, or roller bottles, more particularly in small culture flasks such as 25 cm² cultures flasks. In one preferred embodiment, cells are cultured at high cell density to promote the suppression of asymmetric cell kinetics.

Conditions for culturing should be close to physiological conditions. The pH of the culture medium should be close to physiological pH, preferably between pH 6-8, more preferably between about pH 7 to 7.8, with pH 7.4 being most preferred. Physiological temperatures range between about 30.degree. C. to 40.degree. C. Cells are preferably cultured at temperatures between about 32.degree. C. to about 38.degree. C., and more preferably between about 35.degree. C. to about 37.degree. C.

Cells are preferably cultured for 3-30 days, preferably at least about 7 days, more preferably at least 10 days, still more preferably at least about 14 days. Cells can be cultured substantially longer. They can also be frozen using known methods such as cryopreservation, and thawed and used as needed.

EXAMPLE

Specific markers for adult stem cells (also referred to as non-embroyonic stem cells) (ASCs) are essential for ASC research, tissue engineering, and biomedicine. Lack of molecular markers that are unique for ASCs has been major barrier to the initial identification and pure isolation of ASCs. Recent efforts to understand ASC-specific gene expression profiles have provided limited information on specific markers for ASCs, partially due to difficulty in obtaining pure ASCs. We approached this problem by targeting asymmetric self-renewal, which we have found is a defining property of ASCs.

Recently, global gene expression profiles have been reported for stem cells based on comparisons of genes expressed in embryonic stem cells (ESCs) to genes expressed in ASC-enriched preparations. These include hematopoietic stem cell (HSC)-enriched fractions, cultured neural stem cells (NSCs), and cultured retinal progenitor cells (RPCs) (1-3). These populations also contain a significant fraction of non-stem cell progenitors and differentiating progeny cells that limit their utility for identifying genes whose expression is unique to stem cells, i.e., sternness genes (1-4). In addition, gene expression profiles based on specific expression in both ESCs and ASC-enriched populations will exclude genes whose expression is specific to either of these distinctive stem cell classes. One essential difference is that ESCs propagate in culture by symmetric self-renewal, whereas ASCs are defined by asymmetric self-renewal (5, 6).

We applied a novel strategy to identify genes whose expression levels are related to ASC function based on targeting their unique asymmetric self-renewal. Mammalian ASCs self-renew asymmetrically to replenish cells in tissues that undergo cell turnover but maintain a constant cell mass (5, 6). Each asymmetric ASC division yields a new stem cell and a non-stem cell sister (FIG. 1). The non-stem cell sister becomes the progenitor of the differentiated cells responsible for mature tissue functions (5, 6). Because asymmetric self-renewal is unique to ASCs, some genes whose expression profiles are associated with asymmetric self-renewal may specify adult sternness and also identify ASCs.

We were able to pursue this strategy because of the availability of cultured cell lines that express asymmetric self-renewal conditionally. Restoration of normal wild-type p53 protein expression induces these lines to undergo asymmetric self-renewal like ASCs (7-9). When p53 expression is reduced, the cells switch to symmetric self-renewal, resulting in exponential proliferation. In vivo, symmetric self-renewal by ASCs is regulated to increase tissue mass during normal adult maturation and to repair injured tissues (5). When controls that constrain ASCs to asymmetric self-renewal are disrupted (e.g., by p53 mutations), the risk of proliferative disorders like cancer increases (5, 7).

Previously, we derived cell lines with conditional self-renewal symmetry from non-tumorigenic, immortalized cells that originated from mouse mammary epithelium ("MME") cells and mouse embryo fibroblasts (MEFs). The self-renewal symmetry of these cells can be reversibly switched between symmetric and asymmetric by varying either culture temperature or Zn concentration, as a consequence of controlling p53 expression with respectively responsive promoters (7-10; see also FIG. 2). These diverse properties allowed a microarray analysis to identify genes whose expression consistently showed the same pattern of change between asymmetric versus symmetric self-renewal.

Using cultured cells with experimentally controlled self-renewal symmetry, we performed an analysis of whole genome transcripts to identify genes whose expression is associated with asymmetric self-renewal using an Affymetrix mouse whole genome microarray.

As shown in FIG. 3, the following three populations of cells were compared. Population 1: p53-null control MEFs (Con-3 cells) cultured in Zn-supplemented medium (9, 10). Population 2: Zn-responsive p53-inducible MEFs in Zn-supplemented medium. Population 3: a previously described derivative of the Zn-responsive p53-inducible MEFs which is stably transfected with a constitutively expressed inosine monophosphate dehydrogenase (IMPDH) gene (8). The purpose of the final population was to provide a comparison of asymmetric versus symmetric self-renewal that was not based on a difference in p53 expression. IMPDH is the rate-limiting enzyme for guanine nucleotide biosynthesis. Its down-regulation by p53 is required for asymmetric self-renewal (8). Therefore, even in Zn-supplemented medium, which induces normal p53 expression, cells derived with a stably expressed IMPDH transgene continue to undergo symmetric self-renewal (8, 9). This abrogation of p53 effects on cell division frequency occurs even though other p53-dependent responses remain intact (8, 10). Under the same conditions, control vector-only transfectants (tC-2 cells) continue to exhibit asymmetric self-renewal (8, 9). Thus, this final comparison was used to exclude genes whose change in expression was primarily due to changes p53 expression and not specifically transitions in self-renewal symmetry.

We performed complimentary microarray analyses with Affymetrix GeneChip® mouse whole genome arrays, analyzing 42,000 genes using a single color assay. The statistical power of this analysis allows PM/MM algorithms for each probe sets representing a single gene, e.g. 11 oligonucleotide cells per each probe set in a GeneChip® 430 2.0 array.

The results of the microarray analyses are depicted in Tables 1-8. More specifically, the results from the microarray analysis were used to place the genes into four groups, based on the gene corresponding to the Affymetrix ID. Gene group 1 includes genes exclusively expressed in cells with asymmetric self-renewal; these genes are found in Table 1, SEQ ID NOs: 1-141. Gene group 2 includes genes exclusively expressed in cells with symmetric self renewal; these genes are found in Table 2, SEQ ID NOs: 142-215. Gene group 3 includes genes which are expressed at higher levels in cells with asymmetric self-renewal as compared to cells with symmetric self-renewal; these genes are found in Table 3, SEQ ID NOs: 216-418. Gene group 4 includes genes which are expressed at higher levels in cells with symmetric self-renewal as compared to cells with asymmetric self-renewal; these genes are found in Table 4, SEQ ID NOs: 419-604.

Tables 1-4 each include the Affymetrix ID number for the probe, as well as the locus link information for that probe, and the corresponding GenBank ID for the mouse gene. The 141 probe sets of Gene group 1 (Table 1) represent 132 different genes. The 74 probe sets of Gene group 2 (Table 2) represent 69 different genes. The 203 probe sets of Gene group 3 (Table 3) represent 188 different genes. The 186 probe sets of Gene group 4 (Table 4) represent 170 different genes. FIG. 5 shows examples of several genes representative of each gene group.

The genes of Gene group 1, those genes exclusively expressed in cells exhibiting asymmetric self-renewal, were further analyzed. Tables 5-6 represent particularly preferred genes for identification of cells expressing asymmetric self-renewal. Thirteen of these genes exhibit a high level of expression in the microarray and are predicted to encode membrane spanning proteins. Cell surface expressed proteins are particularly useful as markers for cell states, because they are excellent potential targets for the development of antibodies for use in detecting cells. Seven of these genes fall within 15 megabases of mouse chromosome 2, as indicated in Table 5. This region is also associated with the Philadelphia chromosome translocation, and is a candidate for a chromatin domain associated with aymmetric self-renewal. None of the genes associated with symmetric self-renewal are located in this region. Table 5 provides the gene name and GenBank ID for the mouse genes; Table 6 provides the gene name and GenBank ID for the corresponding human gene.

The genes of Gene group 1, those genes exclusively expressed in cells exhibiting asymmetric self-renewal, were compared to expression profiles reported for several stem cell populations. The genes in Table 7 were identified as members of Gene group 1 in the present analysis; these genes were also identified as associated with stem cells in one of five previous reports, as follows. A "+" in the column indicates that the Affymetrix ID was also identified as being expressed in a cell type previously reported in the named reference. "ES" indicates genes expressed in embryonic stem cells, "NS" refers to genes expressed in neural stem cells, "HS" refers to genes expressed in hematopoietic stem cells, and "RP" refers to genes expressed in retinal precursor cells. The columns labeled "Melton" refer to the results of Ramalho-Santos, M., et al., (2002). Stemness: Transcriptional profiling of embryonic and adult stem cells. Science. 298, 597-600. The columns labeled "Lemischka" refer to the results of Ivanova, N. B., et al., (2002). A stem cell molecular signature. Science 298, 601-604. The columns labeled "Fortunel" refer to the results of Fortunel et al. (2003) Science. 302, 393b. The Group 1 genes were also compared to the results of the following two papers; however, no overlapping genes were identified: Tumbar, T., et al., (2004). Defining the epithelial stem cell niche in skin. Science. 303, 359-363; and Morris, R. J., et al., Capturing and profiling adult hair follicle stem cells. (2004). Nat. Biotech. 22, 411-417.

The genes in Table 8 were identified as members of Gene group 1 in the present analysis; these genes were not previously identified as associated with stem cells in one of five previously discussed reports of stem cell expression profiles (Ramalho-Santos et al., Ivanova et al., Fortunel et al., Tumbar et al., and Morris et al.).

Figure 4:
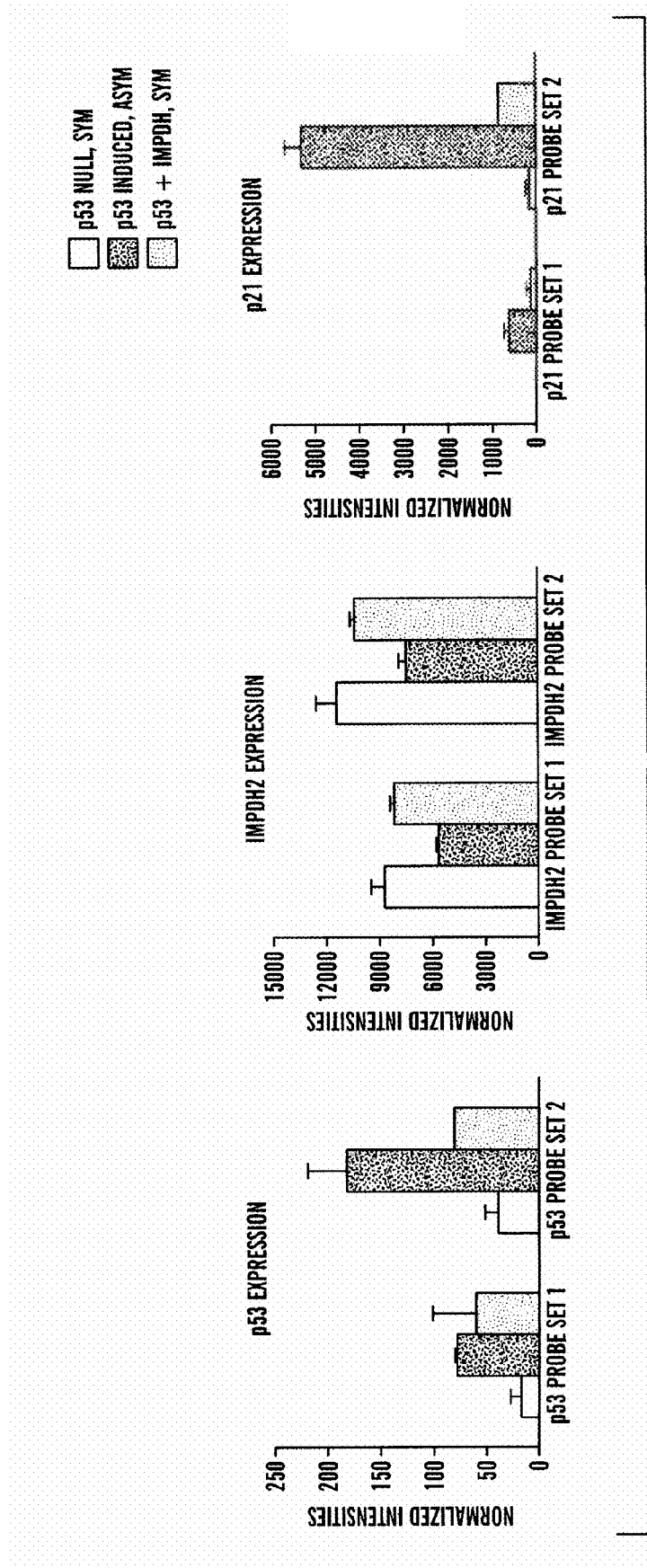
FIG. 4 shows three graphs of expression of p53, IMPDH2, and p21 using two different probe sets to analyze three populations of cells: p53 null cells, which exhibit symmetric self-renewal; p53 induced cells, which exhibit asymmetric self-renewal; and p53 induced cells which also express IMPDH, which exhibit symmetric self-renewal.
Figure 6:
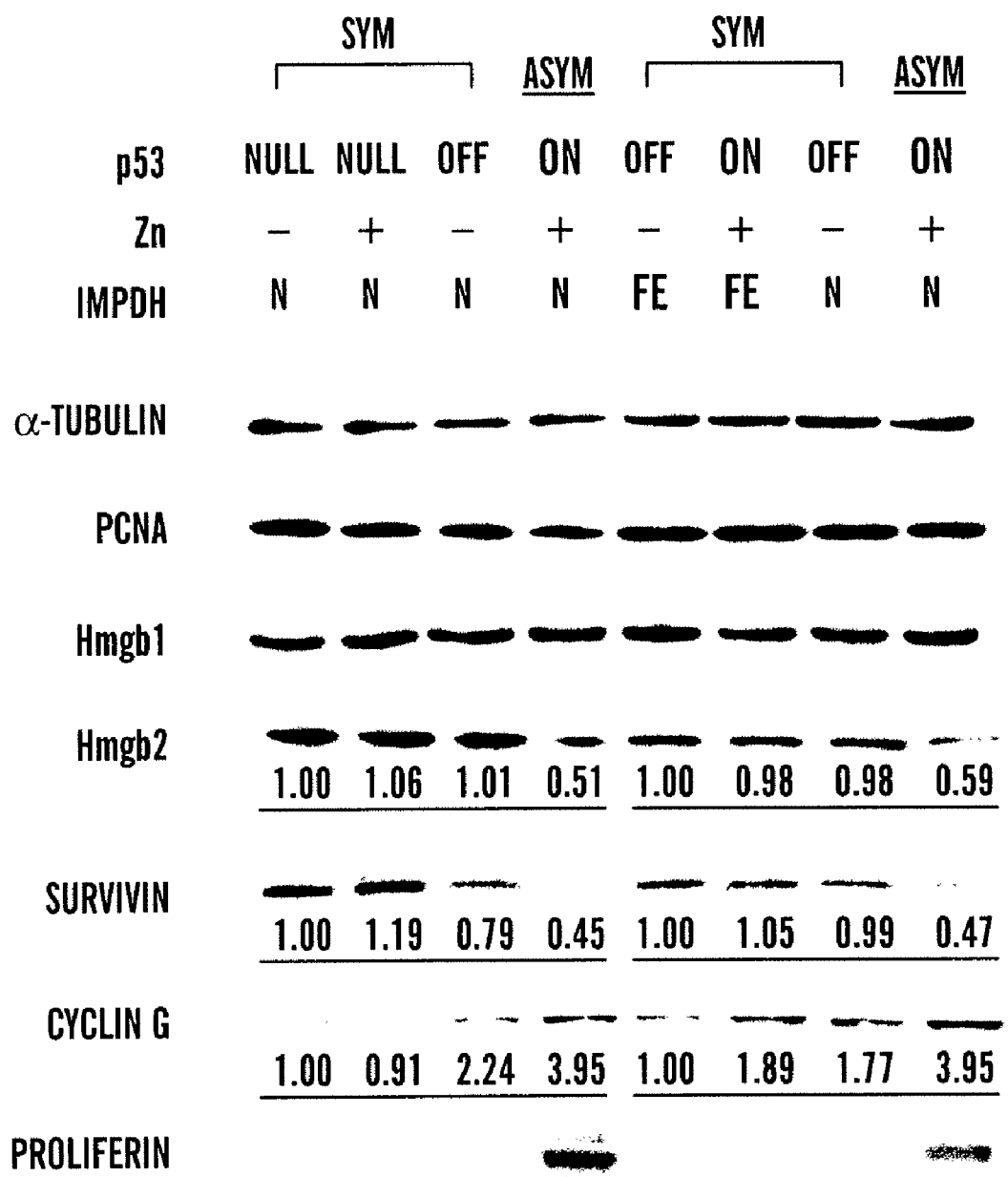
FIG. 6 shows a Western blot confirming the expression of several genes identified by evaluation of whole genome transcripts associated with different cell self-renewal states.
Figure 7:
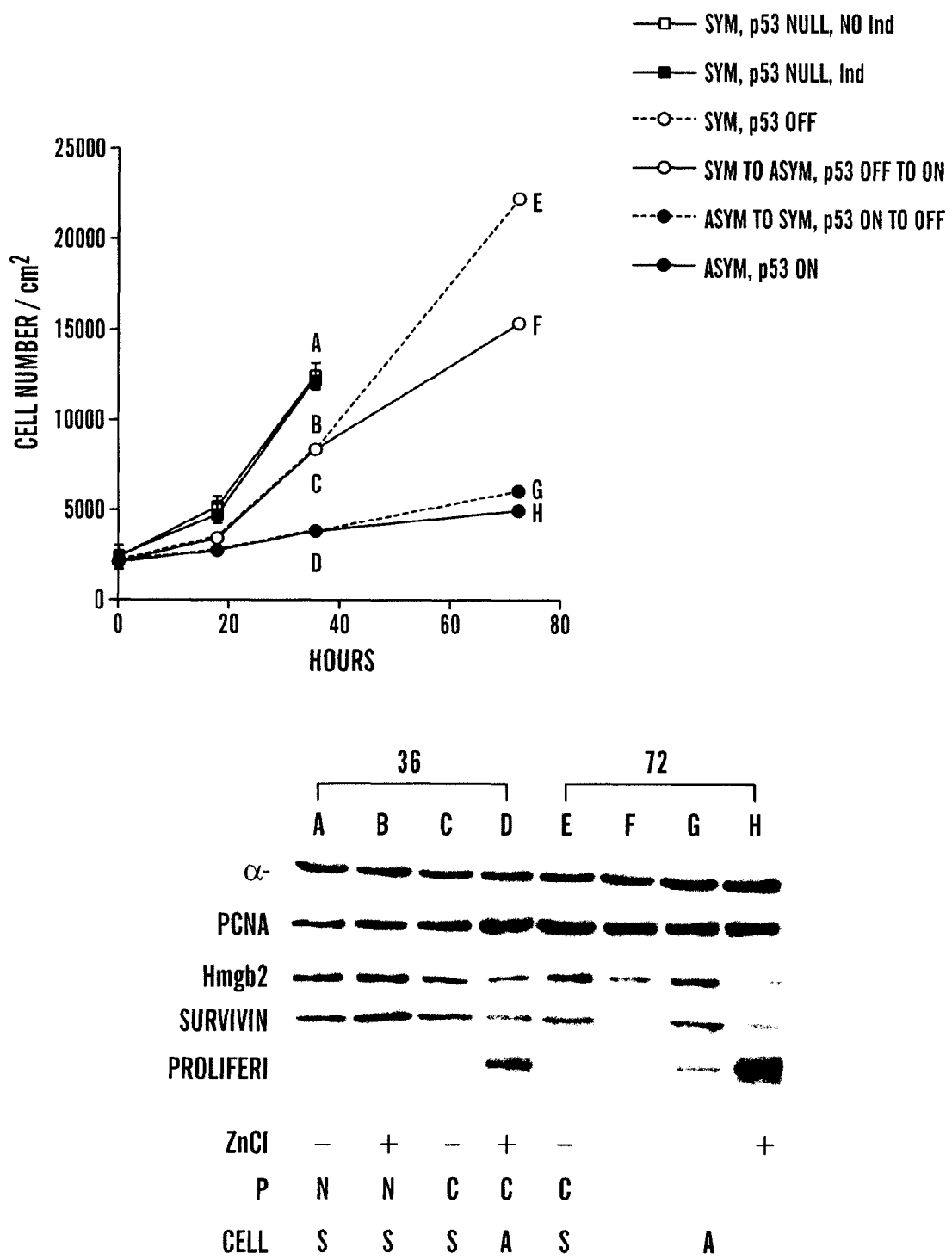
FIG. 7 shows the expression of several proteins exclusively expressed in cells exhibiting asymmetric self-renewal.

Western blotting studies showed that proteins encoded by several asymmetric self-renewal associated genes changed in expression level as predicted by microarray studies. FIG. 4 shows three graphs of expression of p53, IMPDH2, and p21 using two different probe sets to analyze three populations of cells: p53 null cells, which exhibit symmetric self-renewal; p53 induced cells, which exhibit asymmetric self-renewal; and p53 induced cells which also express IMPDH, which exhibit symmetric self-renewal. FIG. 6 shows a Western blot confirming the expression of several genes identified by evaluation of whole genome transcripts associated with different cell self-renewal states. We have confirmed protein expression for several ASRA genes, including survivin, HMGB2, cyclin G, and proliferin. These ASRA proteins dynamically change their expression dependent on self-renewal symmetry states. FIG. 7 shows the expression of several proteins exclusively expressed in cells exhibiting asymmetric self-renewal, including as they transition.

Figure 8:
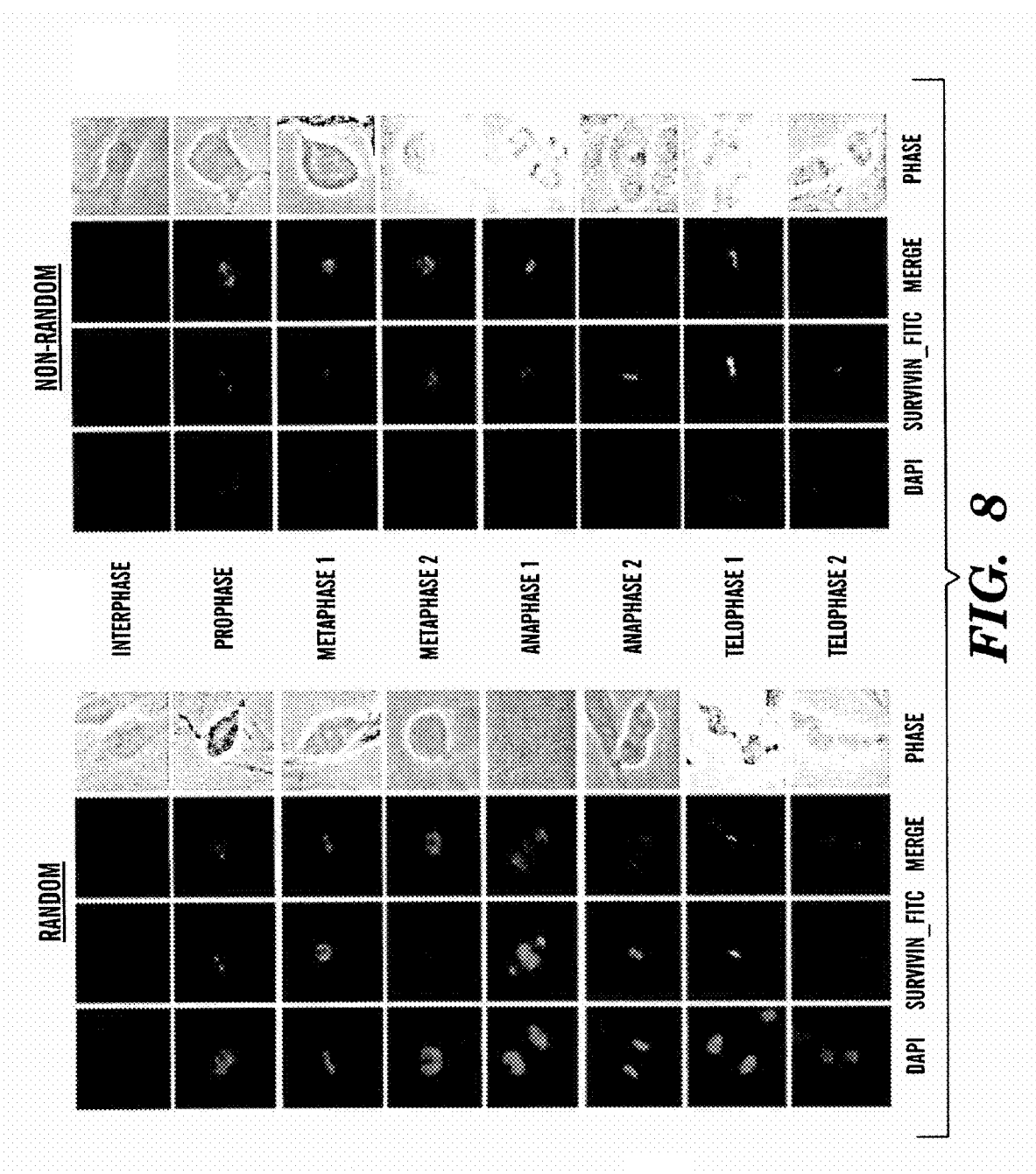
FIG. 8 shows change in the localization of survivin, an asymmetric self-renewal associated gene down-regulated during ASR, during the different stages of mitosis in asymmetrically self-renewing (non-random chromosome segregation) cells compared to symmetrically self-renewing cells (random chromosome segregation). The localization of survivin is normal in asymmetrically self-renewing cells (non-random chromosome segregation), except in telophase when it is often undetectable in centrosomes.
Figure 9:
FIG. 9 shows that survivan localization to the centrosome is reduced during non-random chromosome segregation. These data represent quantitative analysis of survivin localization during prophase, metaphase, anaphase, and telophase in asymmetrically self-renewing (non-random chromosome segregation) cells compared to symmetrically self-renewing cells (random chromosome segregation).

FIG. 8 shows localization of survivin, an asymmetric self-renewal associated gene down-regulated during ASR, during the different stages of mitosis in asymmetrically self-renewing (non-random chromosome segregation) cells compared to symmetrically self-renewing cells (random chromosome segregation). The localization of survivin is normal in asymmetrically self-renewing cells (non-random chromosome segregation), except in telophase when it is often undetectable in centrosomes. FIG. 9 shows quantitative analysis of survivin localization during prophase, metaphase, anaphase, and telophase in asymmetrically self-renewing (non-random chromosome segregation) cells compared to symmetrically self-renewing cells (random chromosome segregation).

The expression pattern of various ASRA proteins can be used to identify self-renewal symmetry state in culture. As more ASRA proteins are evaluated, the specificity and sensitivity of this phenotypic signature will increase. In concept, this set of ASRA proteins will also provide a proteomic signature that uniquely identifies ASCs When ASRA genes were compared with the sets of differentially expressed genes in ASC-enriched preparations, nearly all ASRA genes were included in sets of ASC-specific genes. However, association between ASRA genes and embryonic stem cell (ESC)-specific genes was not significant.

We have shown that genes whose expression is dependent on self-renewal symmetry states are highly represented among genes up-regulated in natural ASC-enriched cell populations.

REFERENCES

1. Sherley, J. L. (2002). Asymmetric cell kinetics genes: the key to expansion of adult stem cells in culture. *Stem Cells*, 20, 561-572.
2. Cairns, J. (2002) Somatic stem cells and the kinetics of mutagenesis and carcinogenesis. *Proc. Natl. Acad. Sci. USA* 99, 10567-10570.
3. Merok, J. R. and Sherley, J. L. (2001). Breaching the kinetic barrier to in vitro somatic stem cell propagation. *J. Biomed. Biotech.* 1, 25-27.
4. Merok, J. R., Lansita, J. A., Tunstead, J. R., and Sherley, J. R. (2002). Cosegregation of chromosomes containing immortal DNA strands in cells that cycle with asymmetric stem cell kinetics. *Cancer Res.*, 62, 6791-6795.
5. Ramalho-Santos, M., Yoon, S., Matsuzaki, Y., Mulligan, R. C. and Melton, D. A. (2002). Stemness: Transcriptional profiling of embryonic and adult stem cells. *Science*. 298, 597-600.
6. Ivanova, N. B., Dimos, J. T., Schaniel, C., Hackney, J. A., Moore, K. A., and Lemischka, I. R. (2002). A stem cell molecular signature. *Science*. 298, 601-604.
7. Fortunel, N. O. et al. (2003) Comment on "'Stemness': transcriptional profiling of embryonic and adult stem cells" and "A stem cell molecular signature" (I). *Science* 302, 393b.
8. Sherley, J. L., Stadler, P. B., and Stadler, J. S. (1995). A quantitative method for the analysis of mammalian cell proliferation in culture in terms of dividing and non-dividing cells. *Cell Prolif.* 28, 137-144.
9. Sherley, J. L., Stadler, P. B., and Johnson, D. R. (1995). Expression of the wild-type p53 antioncogene induces guanine nucleotide-dependent stem cell division kinetics. *Proc. Natl. Acad. Sci. USA* 92, 136-140.
10. Liu, Y., Bohn, S. A., and Sherley, J. L. (1998). Inosine-5'-monophosphate dehydrogenase is a rate-limiting factor for p53-dependent growth regulation *Mol. Biol. Cell* 9, 15-28.
11. Rambhatla L. et al. (2001). Cellular senescence: ex vivo p53-dependent asymmetric cell kinetics. *J. Biomed. Biotech.* 1, 28-37.
12. Altieri, D. C. (2003). Validating survivin as a cancer therapeutic target. *Nature Rev. Cancer.* 3, 46-54.
13. Tanaka, T. U., Rachidi, N., Janke, C., Pereira, G., Galova, M., Schiebel, E., Stark, M. J. R and Nasmyth, K. (2002). Evidence that the Ipl1-Sli15 (Aurora Kinase-INCENP) Complex Promotes All references described herein are incorporated herein by reference.

TABLE 1

141 Genes of Gene Set 1: Exclusive Asymmetric Self-Renewal

| SEQ ID NO: | GenBank ID | Locus Link | Affy ID | Gene name |
|---|---|---|---|---|
| 1 | BC009132 | 11490 | 1425170_a_at | a disintegrin and metalloproteinase domain 15 (metargidin) |
| 2 | NM_007423 | 11576 | 1416645_a_at | alpha fetoprotein |
| 3 | NM_009676 | 11761 | 1419435_at | aldehyde oxidase 1 |
| 4 | D16220 | 12519 | 1451950_a_at | CD80 antigen |
| 5 | AK019867 | 12519 | 1432826_a_at | CD80 antigen |
| 6 | NM_007669 | 12575 | 1421679_a_at | cyclin-dependent kinase inhibitor 1A (P21) |
| 7 | NM_013492 | 12759 | 1418626_a_at | clusterin |
| 8 | BQ173923 | 12808 | 1434917_at | cordon-bleu |
| 9 | BB731671 | 12810 | 1423285_at | coagulation factor C homolog (*Limulus polyphemus*) |
| 10 | NM_009925 | 12813 | 1422253_at | procollagen, type X, alpha 1 |
| 11 | NM_020010 | 13121 | 1422534_at | cytochrome P450, family 51 |
| 12 | BB003660 | 13429 | 1456346_at | Dynamin 1 |
| 13 | NM_007932 | 13805 | 1417271_a_at | endoglin |
| 14 | NM_007680 | 13848 | 1418051_at | Eph receptor B6 |
| 15 | NM_007955 | 13924 | 1449957_at | protein tyrosine phosphatase, receptor type, V |
| 16 | AK014353 | 13992 | 1453317_a_at | KH domain containing, RNA binding, signal transduction associated 3 |
| 17 | BB040642 | 14239 | 1437820_at | forkhead-like 18 (*Drosophila*) |
| 18 | NM_008026 | 14247 | 1422024_at | Friend leukemia integration 1 |
| 19 | BB355415 | 14660 | 1435708_at | Glutaminase |
| 20 | NM_010327 | 14724 | 1422977_at | glycoprotein Ib, beta polypeptide |
| 21 | AK016567 | 14758 | 1423091_a_at | glycoprotein m6b |
| 22 | AV352659 | 14793 | 1448001_x_at | cell division cycle associated 3 |
| 23 | NM_008398 | 16404 | 1418393_a_at | integrin alpha 7 |
| 24 | BC021876 | 16456 | 1424595_at | F11 receptor |
| 25 | NM_008485 | 16782 | 1421279_at | laminin, gamma 2 |
| 26 | AI255256 | 17912 | 1448990_a_at | myosin IB |
| 27 | AI255256 | 17912 | 1448989_a_at | myosin IB |
| 28 | AA406997 | 17912 | 1459679_s_at | myosin IB |

TABLE 1-continued

141 Genes of Gene Set 1: Exclusive Aymmetric Self-Renewal

| SEQ ID NO: | GenBank ID | Locus Link | Affy ID | Gene name |
|---|---|---|---|---|
| 29 | NM_008714 | 18128 | 1418633_at | Notch gene homolog 1 (*Drosophila*) |
| 30 | AI152800 | 18164 | 1434877_at | neuronal pentraxin 1 |
| 31 | BB221015 | 18595 | 1438946_at | platelet derived growth factor receptor, alpha polypeptide |
| 32 | M30697 | 18671 | 1419758_at | ATP-binding cassette, sub-family B (MDR/TAP), member 1A |
| 33 | NM_011086 | 18711 | 1422994_at | phosphatidylinositol-3-phosphate/phosphatidylinositol 5-kinase, type III |
| 34 | NM_008905 | 19024 | 1417801_a_at | protein tyrosine phosphatase, receptor-type, F interacting protein, binding protein 2 |
| 35 | BM236743 | 19249 | 1452127_a_at | protein tyrosine phosphatase, non-receptor type 13 |
| 36 | U63146 | 19662 | 1426225_at | retinol binding protein 4, plasma |
| 37 | NM_009066 | 19763 | 1422647_at | ring finger protein 1 |
| 38 | M75135 | 20527 | 1421924_at | solute carrier family 2 (facilitated glucose transporter), member 3 |
| 39 | NM_011405 | 20540 | 1417392_a_at | solute carrier family 7 (cationic amino acid transporter, y+ system), member 7 |
| 40 | AF041862 | 20975 | 1425217_a_at | synaptojanin 2 |
| 41 | AA242096 | 22057 | 1440844_at | Transducer of ErbB-2.1 |
| 42 | AJ297973 | 22059 | 1427739_a_at | transformation related protein 53 |
| 43 | NM_009430 | 22072 | 1417682_a_at | protease, serine, 2 |
| 44 | BI694835 | 22214 | 1418632_at | ubiquitin-conjugating enzyme E2H |
| 45 | BB549686 | 22715 | 1450929_at | zinc finger protein 57 |
| 46 | BC012637 | 23923 | 1418519_at | aminoadipate aminotransferase |
| 47 | AK006949 | 23945 | 1453836_a_at | monoglyceride lipase |
| 48 | BF786072 | 23972 | 1421987_at | 3'-phosphoadenosine 5'-phosphosulfate synthase 2 |
| 49 | BQ180352 | 23984 | 1419389_at | phosphodiesterase 10A |
| 50 | AW123977 | 23984 | 1458499_at | Phosphodiesterase 10A |
| 51 | NM_012043 | 26968 | 1418450_at | immunoglobulin superfamily containing leucine-rich repeat |
| 52 | NM_013850 | 27403 | 1419238_at | ATP-binding cassette, sub-family A (ABC1), member 7 |
| 53 | NM_023143 | 50909 | 1417009_at | complement component 1, r subcomponent |
| 54 | NM_030598 | 53901 | 1450243_a_at | Down syndrome critical region gene 1-like 1 |
| 55 | AK017474 | 56464 | 1451019_at | cathepsin F |
| 56 | BG070144 | 56480 | 1457459_at | TANK-binding kinase 1 |
| 57 | BC018613 | 56807 | 1451224_at | secretory carrier membrane protein 5 |
| 58 | AV174616 | 57259 | 1417310_at | transducer of ERBB2, 2 |
| 59 | BB437937 | 66912 | 1443227_at | Basic leucine zipper and W2 domains 2 |
| 60 | AF342737 | 67378 | 1424478_at | Bardet-Biedl syndrome 2 homolog (human) |
| 61 | BB559706 | 67448 | 1418912_at | plexin domain containing 2 |
| 62 | BB736636 | 68545 | 1437451_at | RIKEN cDNA 1110006O17 gene |
| 63 | AW259452 | 68695 | 1452875_at | RIKEN cDNA 1110033O09 gene |
| 64 | BC019937 | 68777 | 1451479_a_at | RIKEN cDNA 1110038M16 gene |
| 65 | AK005731 | 69327 | 1428705_at | RIKEN cDNA 1700007K13 gene |
| 66 | BB039237 | 70524 | 1429899_at | RIKEN cDNA 5730414N17 gene |
| 67 | NM_027650 | 71026 | 1421668_x_at | spermatogenesis associated glutamate (E)-rich protein 3 |
| 68 | AU016566 | 71504 | 1430097_at | RIKEN cDNA 8430436C05 gene |
| 69 | BC028271 | 71795 | 1428025_s_at | phosphatidylinositol transfer protein, cytoplasmic 1 |
| 70 | AU020235 | 72043 | 1447602_x_at | sulfatase 2 |
| 71 | BB806780 | 72296 | 1436014_a_at | RUN and SH3 domain containing 1 |
| 72 | BB525750 | 72962 | 1429546_at | endothelial cell growth factor 1 (platelet-derived) |
| 73 | AK006897 | 73451 | 1453959_at | RIKEN cDNA 1700065O13 gene |
| 74 | BC026495 | 73873 | 1451653_a_at | RIKEN cDNA 4930430E16 gene |
| 75 | AK016407 | 75385 | 1432438_at | RIKEN cDNA 4930597L12 gene |
| 76 | AK005633 | 75480 | 1452863_at | RIKEN cDNA 1700003F12 gene |
| 77 | AK006481 | 75570 | 1429098_s_at | RIKEN cDNA 1700029B21 gene |
| 78 | BC019446 | 75605 | 1427142_s_at | jumonji, AT rich interactive domain 1B (Rbp2 like) |
| 79 | AK016374 | 75879 | 1432112_at | RIKEN cDNA 4930589L23 gene |
| 80 | BE197989 | 75958 | 1430766_at | RIKEN cDNA 5033403F01 gene |
| 81 | BG070932 | 77481 | 1439194_at | RIKEN cDNA C030048H21 gene |
| 82 | AB074008 | 79196 | 1425391_a_at | oxysterol binding protein-like 5 |
| 83 | NM_030712 | 80901 | 1422812_at | chemokine (C—X—C motif) receptor 6 |

TABLE 1-continued

141 Genes of Gene Set 1: Exclusive Asymmetric Self-Renewal

| SEQ ID NO: | GenBank ID | Locus Link | Affy ID | Gene name |
|---|---|---|---|---|
| 84 | AF237627 | 93689 | 1427485_at | leiomodin 1 (smooth muscle) |
| 85 | BM230348 | 93871 | 1452322_a_at | WD repeat domain 9 |
| 86 | AF396656 | 94089 | 1425743_at | tripartite motif protein 7 |
| 87 | BB131106 | 99326 | 1433553_at | GTPase activating RANGAP domain-like 3 |
| 88 | BB009770 | 101883 | 1441880_x_at | hypothetical protein MGC30332 |
| 89 | BG075556 | 103012 | 1435744_at | RIKEN cDNA 6720401G13 gene |
| 90 | AA215276 | 103844 | 1448034_at | expressed sequence AI842396 |
| 91 | BC016109 | 105859 | 1451147_x_at | expressed sequence AI481750 |
| 92 | BC016109 | 105859 | 1423845_at | expressed sequence AI481750 |
| 93 | BC024599 | 108897 | 1451287_s_at | RIKEN cDNA 2810003C17 gene |
| 94 | BB049759 | 109050 | 1444723_at | RIKEN cDNA 6530418L21 gene |
| 95 | BQ174638 | 109676 | 1434264_at | Ankyrin 2, brain |
| 96 | BB148652 | 117591 | 1426568_at | solute carrier family 2 (facilitated glucose transporter), member 9 |
| 97 | AF281141 | 170740 | 1425816_at | zinc finger protein 287 |
| 98 | NM_134159 | 171095 | 1419671_a_at | interleukin 17 receptor C |
| 99 | BI217574 | 192166 | 1448426_at | Sarcosine dehydrogenase |
| 100 | BB233055 | 215160 | 1426443_at | rhomboid, veinlet-like 7 (*Drosophila*) |
| 101 | BB332542 | 216438 | 1437366_at | CDNA sequence BC019560 |
| 102 | BB275142 | 218232 | 1437613_s_at | expressed sequence AW456874 |
| 103 | BB226235 | 223864 | 1437012_x_at | Rap guanine nucleotide exchange factor (GEF) 3 |
| 104 | AW491150 | 226778 | 1449630_s_at | MAP/microtubule affinity-regulating kinase 1 |
| 105 | BB196807 | 227659 | 1434015_at | solute carrier family 2 (facilitated glucose transporter), member 6 |
| 106 | BC019122 | 229608 | 1425868_at | Similar to Histone H2B 291B |
| 107 | BC025441 | 229699 | 1426082_a_at | solute carrier family 16 (monocarboxylic acid transporters), member 4 |
| 108 | AK008716 | 231440 | 1428891_at | RIKEN cDNA 9130213B05 gene |
| 109 | BB770954 | 233887 | 1426563_at | zinc finger protein 553 |
| 110 | AW546508 | 234779 | 1426926_at | phospholipase C, gamma 2 |
| 111 | BB398201 | 235184 | 1456287_at | RIKEN cDNA 2810450G17 gene |
| 112 | BB740339 | 237898 | 1443689_at | Ubiquitin specific protease 32 |
| 113 | AI851014 | 242584 | 1434793_at | cDNA sequence BC028975 |
| 114 | NM_054076 | 269120 | 1420578_at | opticin |
| 115 | BF457736 | 269717 | 1434762_at | RIKEN cDNA A730041O15 gene |
| 116 | BB215355 | 319481 | 1456638_at | RIKEN cDNA 5430401O09 gene |
| 117 | AI503156 | 319960 | 1457415_a_at | RIKEN cDNA 4930513N10 gene |
| 118 | BB493717 | 320827 | 1434645_at | RIKEN cDNA C530008M17 gene |
| 119 | BG069663 | 327989 | 1434277_a_at | hypothetical protein 6430570G24 |
| 120 | BI732921 | 380969 | 1427015_at | similar to KIAA1602 protein |
| 121 | BB046613 | 381820 | 1446155_at | RIKEN cDNA 2700089E24 gene |
| 122 | BE225694 | 386655 | 1454931_at | CREBBP/EP300 inhibitory protein 2 |
| 123 | AV010392 | 407822 | 1454830_at | cDNA sequence BC063774 |
| 124 | BM250342 | 434234 | 1434327_at | RIKEN cDNA 2610020H08 gene |
| 125 | BB734586 | | 1443687_x_at | gb: BB734586 /DB_XREF = gi: 16133736 /DB_XREF = BB734586 /CLONE = F420010L19 /FEA = EST /CNT = 3 /TID = Mm.218251.1 /TIER = ConsEnd /STK = 3 /UG = Mm.218251 /UG_TITLE = ESTs, Weakly similar to TYROSINE-PROTEIN KINASE JAK3 (*M. musculus*) |
| 126 | BE370618 | | 1455970_at | Transcribed locus |
| 127 | BB734586 | | 1443686_at | gb: BB734586 /DB_XREF = gi: 16133736 /DB_XREF = BB734586 /CLONE = F420010L19 /FEA = EST /CNT = 3 /TID = Mm.218251.1 /TIER = ConsEnd /STK = 3 /UG = Mm.218251 /UG_TITLE = ESTs, Weakly similar to TYROSINE-PROTEIN KINASE JAK3 (*M. musculus*) |
| 128 | AV273409 | | 1436978_at | gb: AV273409 /DB_XREF = gi: 16390310 /DB_XREF = AV273409 /CLONE = 4932411A18 /FEA = EST /CNT = 32 /TID = Mm.78839.1 /TIER = Stack /STK = 32 /UG = Mm.78839 /UG_TITLE = ESTs |
| 129 | BE335227 | | 1455165_at | Transcribed locus |

TABLE 1-continued

141 Genes of Gene Set 1: Exclusive Asymmetric Self-Renewal

| SEQ ID NO: | GenBank ID | Locus Link | Affy ID | Gene name |
|---|---|---|---|---|
| 130 | BM225081 | | 1444418_at | Transcribed locus |
| 131 | BF451402 | | 1455396_at | Transcribed locus |
| 132 | NM_010387 | | 1418638_at | gb: NM_010387.1 /DB_XREF = gi: 6754121 /GEN = H2-DMb1 /FEA = FLmRNA /CNT = 83 /TID = Mm.3322.1 /TIER = FL + Stack /STK = 20 /UG = Mm.3322 /LL = 14999 /DEF = *Mus musculus* histocompatibility 2, class II, locus Mb1 (H2-DMb1), mRNA. /PROD = histocompatibility 2, class II, locus Mb1 /FL = gb: NM_010387.1 gb: BC002237.1 gb: BC003718.1 gb: U35333.1 gb: U35332.1 gb: U35331.1 gb: U35330.1 gb: U35329.1 |
| 133 | AA406997 | | 1447364_x_at | gb: AA406997 /DB_XREF = gi: 2066918 /DB_XREF = EST02003 /CLONE = C0016E06 /FEA = EST /CNT = 2 /TID = Mm.200345.1 /TIER = ConsEnd /STK = 2 /UG = Mm.200345 /LL = 98177 /UG_GENE = AA406997 /UG_TITLE = expressed sequence AA406997 |
| 134 | BB404534 | | 1458894_at | gb: BB404534 /DB_XREF = gi: 16415572 /DB_XREF = BB404534 /CLONE = C330036L23 /FEA = EST /CNT = 3 /TID = Mm.132632.1 /TIER = ConsEnd /STK = 2 /UG = Mm.132632 /UG_TITLE = ESTs |
| 135 | BB365629 | | 1441906_x_at | gb: BB365629 /DB_XREF = gi: 9077457 /DB_XREF = BB365629 /CLONE = C130030B22 /FEA = EST /CNT = 4 /TID = Mm.119251.1 /TIER = ConsEnd /STK = 4 /UG = Mm.119251 /UG_TITLE = ESTs |
| 136 | BB234186 | | 1458849_at | gb: BB234186 /DB_XREF = gi: 16354657 /DB_XREF = BB234186 /CLONE = A630048A04 /FEA = EST /CNT = 3 /TID = Mm.207258.1 /TIER = ConsEnd /STK = 2 /UG = Mm.207258 /UG_TITLE = ESTs |
| 137 | AK020707 | | 1433358_at | gb: AK020707.1 /DB_XREF = gi: 12861375 /FEA = mRNA /CNT = 1 /TID = Mm.159985.1 /TIER = ConsEnd /STK = 0 /UG = Mm.159985 /LL = 77747 /UG_GENE = A230102O21Rik /UG_TITLE = RIKEN cDNA A230102O21 gene /DEF = *Mus musculus* adult male hypothalamus cDNA, RIKEN full-length enriched library, clone: A230102O21: unclassifiable, full insert sequence. |
| 138 | BB197269 | | 1438431_at | gb: BB197269 /DB_XREF = gi: 16271050 /DB_XREF = BB197269 /CLONE = A330098C23 /FEA = EST /CNT = 31 /TID = Mm.104643.2 /TIER = Stack /STK = 10 /UG = Mm.104643 /LL = 99151 /UG_GENE = AL024097 /UG_TITLE = expressed sequence AL024097 |
| 139 | BB333400 | | 1439011_at | gb: BB333400 /DB_XREF = gi: 16403996 /DB_XREF = BB333400 /CLONE = B830011C12 /FEA = EST /CNT = 80 /TID = Mm.153.2 /TIER = Stack /STK = 8 /UG = Mm.153 /LL = 72123 /UG_GENE = 2010109K11Rik /UG_TITLE = RIKEN cDNA 2010109K11 gene |

TABLE 1-continued

141 Genes of Gene Set 1: Exclusive Aymmetric Self-Renewal

| SEQ ID NO: | GenBank ID | Locus Link | Affy ID | Gene name |
|---|---|---|---|---|
| 140 | NM_019576 | | 1418205_at | gb: BB418472 /DB_XREF = gi: 16423414 /DB_XREF = BB418472 /CLONE = C530010H06 /FEA = FLmRNA /CNT = 61 /TID = Mm.32067.1 /TIER = ConsEnd /STK = 6 /UG = Mm.32067 /LL = 56229 /UG_GENE = Tmtsp-pending /UG_TITLE = transmembrane molecule with thrombospondin module /FL = gb: NM_019576.1 gb: AB039946.1 |
| 141 | BE981473 | | 1437641_at | gb: BE981473 /DB_XREF = gi: 10650615 /DB_XREF = UI-M-CG0p-bdc-e-12-0-UI.s1 /CLONE = UI-M-CG0p-bdc-e-12-0-UI /FEA = EST /CNT = 28 /TID = Mm.21524.1 /TIER = Stack /STK = 15 /UG = Mm.21524 /LL = 99938 /UG_GENE = BB077382 /UG_TITLE = expressed sequence BB077382 |

TABLE 2

74 Genes of Gene Set 2: Exclusive Symmetric Self-Renewal

| SEQ ID NO: | GenBank ID | Locus Link | Affy ID | Gene name |
|---|---|---|---|---|
| 142 | BG066764 | 11808 | 1440513_at | Hypothetical LOC403343 |
| 143 | AA016422 | 12404 | 1423286_at | cerebellin 1 precursor protein |
| 144 | AV227581 | 12737 | 1437932_a_at | claudin 1 |
| 145 | NM_016674 | 12737 | 1450014_at | claudin 1 |
| 146 | NM_013496 | 12903 | 1448326_a_at | cellular retinoic acid binding protein I |
| 147 | NM_010099 | 13607 | 1419597_at | ectodysplasin-A |
| 148 | NM_010101 | 13610 | 1460661_at | endothelial differentiation, sphingolipid G-protein-coupled receptor, 3 |
| 149 | M68513 | 13837 | 1425574_at | Eph receptor A3 |
| 150 | AU043193 | 14365 | 1450135_at | frizzled homolog 3 (*Drosophila*) |
| 151 | AU020229 | 14365 | 1449730_s_at | frizzled homolog 3 (*Drosophila*) |
| 152 | J00406 | 14964 | 1452544_x_at | histocompatibility 2, D region locus 1 |
| 153 | BB730912 | 16164 | 1427165_at | interleukin 13 receptor, alpha 1 |
| 154 | BB152209 | 16906 | 1444459_at | Lamin B1 |
| 155 | AW743020 | 17984 | 1435382_at | necdin |
| 156 | NM_010882 | 17984 | 1415923_at | necdin |
| 157 | AV124445 | 17984 | 1455792_x_at | necdin |
| 158 | BB074430 | 17984 | 1437853_x_at | necdin |
| 159 | BB210535 | 18392 | 1443172_at | origin recognition complex, subunit 1-like (*S. cereviaiae*) |
| 160 | BC002064 | 19242 | 1416211_a_at | pleiotrophin |
| 161 | NM_011252 | 19655 | 1416355_at | RNA binding motif protein, X chromosome |
| 162 | NM_138946 | 20084 | 1421837_at | ribosomal protein S18 |
| 163 | AF004833 | 21788 | 1451790_a_at | tissue factor pathway inhibitor |
| 164 | BF451808 | 21788 | 1452432_at | tissue factor pathway inhibitor |
| 165 | BC003468 | 27401 | 1425072_at | S-phase kinase-associated protein 2 (p45) |
| 166 | BI110565 | 50706 | 1423606_at | periostin, osteoblast specific factor |
| 167 | BE989344 | 51886 | 1442109_at | Far upstream element (FUSE) binding protein 1 |
| 168 | BQ175902 | 52304 | 1455304_at | Unc-13 homolog C (*C. elegans*) |
| 169 | NM_019731 | 56520 | 1416798_a_at | expressed in non-metastatic cells 4, protein |
| 170 | AI504586 | 59057 | 1430651_s_at | Zinc finger protein 191 |
| 171 | AK008394 | 66101 | 1431505_at | peptidyl prolyl isomerase H |
| 172 | AK005131 | 66407 | 1430100_at | mitochondrial ribosomal protein S15 |
| 173 | AI836168 | 66469 | 1423266_at | RIKEN cDNA 2810405K02 gene |
| 174 | BB736518 | 66874 | 1439363_at | RIKEN cDNA 1200014J11 gene |
| 175 | NM_023537 | 69908 | 1422583_at | RAB3B, member RAS oncogene family |
| 176 | AA165746 | 70823 | 1453291_at | high mobility group box 2-like 1 |
| 177 | BM250766 | 71557 | 1429846_at | RIKEN cDNA 9030411K21 gene |

TABLE 2-continued

74 Genes of Gene Set 2: Exclusive Symmetric Self-Renewal

| SEQ ID NO: | GenBank ID | Locus Link | Affy ID | Gene name |
|---|---|---|---|---|
| 178 | NM_028279 | 72560 | 1422671_s_at | N-acetylated alpha-linked acidic dipeptidase 2 |
| 179 | BC019463 | 74320 | 1423874_at | WD repeat domain 33 |
| 180 | BG145107 | 76223 | 1431210_at | RIKEN cDNA 6530406M24 gene |
| 181 | AK009532 | 76946 | 1454031_at | RIKEN cDNA 2310029O18 gene |
| 182 | AK020384 | 77264 | 1454007_a_at | zinc finger protein 142 |
| 183 | BM123174 | 78757 | 1429810_at | RIKEN cDNA 4921505C17 gene |
| 184 | NM_053093 | 93670 | 1420458_at | tachykinin 4 |
| 185 | AI415741 | 94352 | 1431004_at | lysyl oxidase-like 2 |
| 186 | AF117951 | 94352 | 1452436_at | lysyl oxidase-like 2 |
| 187 | NM_134084 | 105675 | 1416940_at | peptidylprolyl isomerase F (cyclophilin F) |
| 188 | AK014755 | 109624 | 1433147_at | caldesmon 1 |
| 189 | BB284358 | 112407 | 1418648_at | EGL nine homolog 3 (*C. elegans*) |
| 190 | BB234087 | 114714 | 1438453_at | Rad51 homolog c (*S. cerevisiae*) |
| 191 | NM_134163 | 171170 | 1422836_at | muscleblind-like 3 (*Drosophila*) |
| 192 | AW553532 | 210530 | 1436178_at | leprecan-like 1 |
| 193 | BB552785 | 212772 | 1430586_at | RIKEN cDNA 2700007P21 gene |
| 194 | BB424872 | 219094 | 1428695_at | RIKEN cDNA 9130227C08 gene |
| 195 | BB318254 | 230648 | 1427979_at | RIKEN cDNA 4732418C07 gene |
| 196 | AV062156 | 233067 | 1456767_at | leucine rich repeat and fibronectin type III domain containing 3 |
| 197 | BB407885 | 234396 | 1443978_at | RIKEN cDNA 8430438L13 gene |
| 198 | AK020004 | 241627 | 1430304_at | RIKEN cDNA 5830411K18 gene |
| 199 | BM214225 | 319285 | 1440083_at | RIKEN cDNA A430061O12 gene |
| 200 | AV336222 | 319535 | 1446820_at | RIKEN cDNA 6330583I20 gene |
| 201 | AW912417 | 399591 | 1455213_at | RIKEN cDNA 4930488E11 gene |
| 202 | BQ268601 | 434436 | 1447393_at | Similar to hypothetical protein FLJ38608 |
| 203 | BB701775 | | 1456284_at | gb: BB701775 /DB_XREF = gi: 16050599 /DB_XREF = BB701775 /CLONE = 7420433A22 /FEA = EST /CNT = 14 /TID = Mm.28264.1 /TIER = Stack /STK = 12 /UG = Mm.28264 /UG_TITLE = ESTs |
| 204 | BB519333 | | 1458025_at | gb: BB519333 /DB_XREF = gi: 16443328 /DB_XREF = BB519333 /CLONE = D830035I11 /FEA = EST /CNT = 4 /TID = Mm.136094.1 /TIER = ConsEnd /STK = 3 /UG = Mm.136094 /UG_TITLE = ESTs |
| 205 | BI664122 | | 1438245_at | gb: BI664122 /DB_XREF = gi: 15578355 /DB_XREF = 603289235F1 /CLONE = IMAGE: 5323376 /FEA = EST /CNT = 18 /TID = Mm.4025.5 /TIER = Stack /STK = 11 /UG = Mm.4025 /LL = 18028 /UG_GENE = Nfib /UG_TITLE = nuclear factor IB |
| 206 | BB053540 | | 1456840_at | 12 days embryo male wolffian duct includes surrounding region cDNA, RIKEN full-length enriched library, clone: 6720464D04 product: unknown EST, full insert sequence |
| 207 | AW489352 | | 1445210_at | gb: AW489352 /DB_XREF = gi: 7059622 /DB_XREF = UI-M-BH3-ata-h-08-0-UI.s1 /CLONE = UI-M-BH3-ata-h-08-0-UI /FEA = EST /CNT = 3 /TID = Mm.190867.1 /TIER = ConsEnd /STK = 2 /UG = Mm.190867 /UG_TITLE = ESTs |
| 208 | BI500065 | | 1460138_at | Transcribed locus, moderately similar to NP_795929.1 RIKEN cDNA 8030475D13 gene [*Mus musculus*] |

TABLE 2-continued

74 Genes of Gene Set 2: Exclusive Symmetric Self-Renewal

| SEQ ID NO: | GenBank ID | Locus Link | Affy ID | Gene name |
|---|---|---|---|---|
| 209 | NM_009647 | | 1450387_s_at | gb: NM_009647.1 /DB_XREF = gi: 6753021 /GEN = Ak4 /FEA = FLmRNA /CNT = 131 /TID = Mm.42040.1 /TIER = FL + Stack /STK = 70 /UG = Mm.42040 /LL = 11639 /DEF = *Mus musculus* adenylate kinase 4 (Ak4), mRNA. /PROD = adenylate kinase 4 /FL = gb: D85036.1 gb: NM_009647.1 gb: AB020239.1 |
| 210 | C80678 | | 1449680_at | gb: C80678 /DB_XREF = gi: 2521008 /DB_XREF = C80678 /CLONE = J0086C01 /FEA = EST /CNT = 1 /TID = Mm.25084.1 /TIER = ConsEnd /STK = 0 /UG = Mm.25084 /LL = 97816 /UG_GENE = C80678 /UG_TITLE = expressed sequence C80678 |
| 211 | AI449062 | | 1457999_at | Transcribed locus, moderately similar to XP_509517.1 similar to tumor suppressor candidate 5 [*Pan troglodytes*] |
| 212 | BG065704 | | 1442487_at | gb: BG065704 /DB_XREF = gi: 12548267 /DB_XREF = H3034C07-3 /CLONE = H3034C07 /FEA = EST /CNT = 4 /TID = Mm.155599.1 /TIER = ConsEnd /STK = 3 /UG = Mm.155599 /LL = 52453 /UG_GENE = D14Ertd24e /UG_TITLE = DNA segment, Chr 14, ERATO Doi 24, expressed |
| 213 | BB043897 | | 1443162_at | gb: BB043897 /DB_XREF = gi: 16259271 /DB_XREF = BB043897 /CLONE = 6030479E06 /FEA = EST /CNT = 3 /TID = Mm.44086.1 /TIER = ConsEnd /STK = 3 /UG = Mm.44086 /UG_TITLE = ESTs |
| 214 | BG083329 | | 1458919_at | gb: BG083329 /DB_XREF = gi: 12565897 /DB_XREF = H3087A09-5 /CLONE = H3087A09 /FEA = EST /CNT = 3 /TID = Mm.163184.1 /TIER = ConsEnd /STK = 2 /UG = Mm.163184 /LL = 101416 /UG_GENE = BB154892 /UG_TITLE = expressed sequence BB154892 |
| 215 | AV306063 | | 1430581_at | gb: AV306063 /DB_XREF = gi: 6338577 /DB_XREF = AV306063 /CLONE = 5730534O06 /FEA = mRNA /CNT = 15 /TID = Mm.182424.1 /TIER = ConsEnd /STK = 1 /UG = Mm.182424 /LL = 70663 /UG_GENE = 5730534O06Rik /UG_TITLE = RIKEN cDNA 5730534O06 gene |

TABLE 3

203 Genes of Gene Set 3: Upregulated in Asymmetric Self-Renewal

| SEQ ID NO: | GenBank ID | Locus Link | Affy ID | Gene name |
|---|---|---|---|---|
| 216 | NM_007403 | 11501 | 1416871_at | a disintegrin and metalloprotease domain 8 |
| 217 | NM_009636 | 11568 | 1450637_a_at | AE binding protein 1 |
| 218 | NM_021515 | 11636 | 1422184_a_at | adenylate kinase 1 |

TABLE 3-continued

203 Genes of Gene Set 3: Upregulated in Asymmetric Self-Renewal

| SEQ ID NO: | GenBank ID | Locus Link | Affy ID | Gene name |
|---|---|---|---|---|
| 219 | NM_013473 | 11752 | 1417732_at | annexin A8 |
| 220 | NM_007494 | 11898 | 1416239_at | argininosuccinate synthetase 1 |
| 221 | NM_007570 | 12227 | 1416250_at | B-cell translocation gene 2, anti-proliferative |
| 222 | BB230296 | 12238 | 1454642_a_at | COMM domain containing 3 |
| 223 | BB234940 | 12305 | 1456226_x_at | discoidin domain receptor family, member 1 |
| 224 | BC010758 | 12409 | 1418509_at | carbonyl reductase 2 |
| 225 | BQ175880 | 12444 | 1434745_at | cyclin D2 |
| 226 | NM_009866 | 12552 | 1450757_at | cadherin 11 |
| 227 | AK016527 | 12554 | 1454015_a_at | cadherin 13 |
| 228 | BQ176681 | 12554 | 1434115_at | cadherin 13 |
| 229 | AF059567 | 12579 | 1449152_at | cyclin-dependent kinase inhibitor 2B (p15, inhibits CDK4) |
| 230 | BG967663 | 12709 | 1455106_a_at | creatine kinase, brain |
| 231 | NM_018827 | 12931 | 1418476_at | cytokine receptor-like factor 1 |
| 232 | NM_009964 | 12955 | 1416455_a_at | crystallin, alpha B |
| 233 | AV016515 | 12955 | 1434369_a_at | crystallin, alpha B |
| 234 | NM_007881 | 13498 | 1421149_a_at | dentatorubral pallidoluysian atrophy |
| 235 | AV346607 | 13655 | 1436329_at | early growth response 3 |
| 236 | NM_007933 | 13808 | 1417951_at | enolase 3, beta muscle |
| 237 | NM_010145 | 13849 | 1422438_at | epoxide hydrolase 1, microsomal |
| 238 | NM_010161 | 14017 | 1450241_a_at | ecotropic viral integration site 2a |
| 239 | NM_010189 | 14132 | 1416978_at | Fc receptor, IgG, alpha chain transporter |
| 240 | M33760 | 14182 | 1424050_s_at | Fibroblast growth factor receptor 1 |
| 241 | NM_010222 | 14231 | 1416803_at | FK506 binding protein 7 |
| 242 | AV026617 | 14281 | 1423100_at | FBJ osteosarcoma oncogene |
| 243 | NM_008046 | 14313 | 1421365_at | follistatin |
| 244 | BB444134 | 14313 | 1434458_at | Follistatin |
| 245 | AB037596 | 14538 | 1425503_at | glucosaminyl (N-acetyl) transferase 2, I-branching enzyme |
| 246 | AF297615 | 14594 | 1418483_a_at | glycoprotein galactosyltransferase alpha 1, 3 |
| 247 | BC003726 | 14789 | 1449531_at | leprecan-like 2 |
| 248 | NM_010357 | 14860 | 1416368_at | glutathione S-transferase, alpha 4 |
| 249 | AF117613 | 15199 | 1418172_at | heme binding protein 1 |
| 250 | NM_010442 | 15368 | 1448239_at | heme oxygenase (decycling) 1 |
| 251 | NM_010444 | 15370 | 1416505_at | nuclear receptor subfamily 4, group A, member 1 |
| 252 | AK005016 | 15473 | 1428326_s_at | heat-responsive protein 12 |
| 253 | U03561 | 15507 | 1425964_x_at | heat shock protein 1 |
| 254 | NM_013560 | 15507 | 1422943_a_at | heat shock protein 1 |
| 255 | NM_008393 | 16373 | 1418517_at | Iroquois related homeobox 3 (Drosophila) |
| 256 | NM_008452 | 16598 | 1448890_at | Kruppel-like factor 2 (lung) |
| 257 | BG069413 | 16600 | 1417394_at | Kruppel-like factor 4 (gut) |
| 258 | AI267126 | 16601 | 1436763_a_at | basic transcription element binding protein 1 |
| 259 | AV354744 | 16601 | 1456341_a_at | basic transcription element binding protein 1 |
| 260 | AV238225 | 16905 | 1457670_s_at | lamin A |
| 261 | NM_013586 | 16950 | 1418269_at | lysyl oxidase-like 3 |
| 262 | NM_013589 | 16997 | 1418061_at | latent transforming growth factor beta binding protein 2 |
| 263 | BM245572 | 17069 | 1453304_s_at | lymphocyte antigen 6 complex, locus E |
| 264 | BB454540 | 17118 | 1456028_x_at | Myristoylated alanine rich protein kinase C substrate |
| 265 | BG868949 | 17122 | 1434378_a_at | RIKEN cDNA 2810410A03 gene |
| 266 | BB338441 | 17181 | 1455978_a_at | matrilin 2 |
| 267 | X58876 | 17246 | 1427718_a_at | transformed mouse 3T3 cell double minute 2 |
| 268 | AK004719 | 17246 | 1423605_a_at | transformed mouse 3T3 cell double minute 2 |
| 269 | BB535494 | 18003 | 1437132_x_at | neural precursor cell expressed, developmentally down-regulated gene 9 |
| 270 | NM_008714 | 18128 | 1418634_at | Notch gene homolog 1 (Drosophila) |
| 271 | BB542051 | 18295 | 1419663_at | osteoglycin |
| 272 | BB542051 | 18295 | 1419662_at | osteoglycin |
| 273 | AB015978 | 18414 | 1418674_at | oncostatin M receptor |
| 274 | AW537708 | 18595 | 1421917_at | platelet derived growth factor receptor, alpha polypeptide |
| 275 | NM_011111 | 18788 | 1419082_at | serine (or cysteine) proteinase inhibitor, clade B, member 2 |

TABLE 3-continued

203 Genes of Gene Set 3: Upregulated in Asymmetric Self-Renewal

| SEQ ID NO: | GenBank ID | Locus Link | Affy ID | Gene name |
|---|---|---|---|---|
| 276 | NM_008873 | 18792 | 1422139_at | plasminogen activator, urokinase |
| 277 | NM_011125 | 18830 | 1417963_at | phospholipid transfer protein |
| 278 | AI591480 | 18830 | 1456424_s_at | phospholipid transfer protein |
| 279 | AK014601 | 19245 | 1418181_at | protein tyrosine phosphatase 4a3 |
| 280 | BF235516 | 19268 | 1420842_at | protein tyrosine phosphatase, receptor type, F |
| 281 | NM_016846 | 19731 | 1449124_at | ral guanine nucleotide dissociation stimulator, -like 1 |
| 282 | BG065230 | 19876 | 1427231_at | round about homolog 1 (Drosophila) |
| 283 | NM_009148 | 20336 | 1422685_at | SEC8-like 1 (S. cerevisiae) |
| 284 | NM_009148 | 20336 | 1422686_s_at | SEC8-like 1 (S. cerevisiae) |
| 285 | BB414515 | 20527 | 1437052_s_at | solute carrier family 2 (facilitated glucose transporter), member 3 |
| 286 | BB219478 | 20650 | 1436986_at | syntrophin, basic 2 |
| 287 | AF068749 | 20698 | 1451596_a_at | sphingosine kinase 1 |
| 288 | NM_020275 | 21933 | 1421296_at | tumor necrosis factor receptor superfamily, member 10b |
| 289 | BB447627 | 22214 | 1438971_x_at | ubiquitin-conjugating enzyme E2H |
| 290 | BB228713 | 22232 | 1439433_a_at | solute carrier family 35 (UDP-galactose transporter), member 2 |
| 291 | NM_011706 | 22368 | 1416935_at | transient receptor potential cation channel, subfamily V, member 2 |
| 292 | NM_016873 | 22403 | 1419015_at | WNT1 inducible signaling pathway protein 2 |
| 293 | BB479063 | 24131 | 1433783_at | LIM domain binding 3 |
| 294 | AF114378 | 24131 | 1451999_at | LIM domain binding 3 |
| 295 | AF188290 | 26903 | 1451891_a_at | dysferlin |
| 296 | BC008105 | 27015 | 1449483_at | polymerase (DNA directed), kappa |
| 297 | NM_013750 | 27280 | 1449002_at | pleckstrin homology-like domain, family A, member 3 |
| 298 | NM_013759 | 27361 | 1418888_a_at | selenoprotein X 1 |
| 299 | BB749092 | 28064 | 1444012_at | DNA segment, Chr 17, Wayne State University 94, expressed |
| 300 | BI739353 | 29858 | 1430780_a_at | phosphomannomutase 1 |
| 301 | BC006809 | 29858 | 1424167_a_at | phosphomannomutase 1 |
| 302 | NM_015772 | 50524 | 1416638_at | sal-like 2 (Drosophila) |
| 303 | NM_015776 | 50530 | 1418454_at | microfibrillar associated protein 5 |
| 304 | BB533903 | 50708 | 1436994_a_at | histone 1, H1c |
| 305 | NM_015786 | 50708 | 1416101_a_at | histone 1, H1c |
| 306 | BB107412 | 52065 | 1429005_at | Malignant fibrous histiocytoma amplified sequence 1 |
| 307 | AK003278 | 52466 | 1426714_at | DNA segment, Chr 11, ERATO Doi 18, expressed |
| 308 | AU014694 | 52666 | 1419978_s_at | DNA segment, Chr 10, ERATO Doi 610, expressed |
| 309 | NM_030598 | 53901 | 1421425_a_at | Down syndrome critical region gene 1-like 1 |
| 310 | NM_133914 | 54153 | 1417333_at | RAS p21 protein activator 4 |
| 311 | NM_019971 | 54635 | 1419123_a_at | platelet-derived growth factor, C polypeptide |
| 312 | AF282255 | 54720 | 1416601_a_at | Down syndrome critical region homolog 1 (human) |
| 313 | AF282255 | 54720 | 1416600_a_at | Down syndrome critical region homolog 1 (human) |
| 314 | AI326893 | 55927 | 1436050_x_at | hairy and enhancer of split 6 (Drosophila) |
| 315 | NM_019631 | 56277 | 1422587_at | transmembrane protein 45a |
| 316 | AV370848 | 56316 | 1423554_at | gamma-glutamyl carboxylase |
| 317 | NM_019790 | 56363 | 1419073_at | transmembrane protein with EGF-like and two follistatin-like domains 2 |
| 318 | NM_019976 | 56742 | 1417323_at | RIKEN cDNA 5430413I02 gene |
| 319 | BC005569 | 58809 | 1422603_at | ribonuclease, RNase A family 4 |
| 320 | NM_022329 | 64164 | 1448958_at | interferon alpha responsive gene |
| 321 | BC010291 | 66141 | 1423754_at | interferon induced transmembrane protein 3 |
| 322 | BG067878 | 66251 | 1426534_a_at | ADP-ribosylation factor GTPase activating protein 3 |
| 323 | AK002304 | 66835 | 1429027_at | RIKEN cDNA 0610007N19 gene |
| 324 | NM_025864 | 66950 | 1417030_at | RIKEN cDNA 2310028N02 gene |
| 325 | AI413098 | 67042 | 1434299_x_at | RAB, member of RAS oncogene family-like 4 |
| 326 | BC017514 | 67042 | 1424648_at | RAB, member of RAS oncogene family-like 4 |
| 327 | AK018383 | 67226 | 1416261_at | transmembrane protein 19 |

TABLE 3-continued

203 Genes of Gene Set 3: Upregulated in Asymmetric Self-Renewal

| SEQ ID NO: | GenBank ID | Locus Link | Affy ID | Gene name |
|---|---|---|---|---|
| 328 | BB006809 | 67260 | 1417780_at | longevity assurance homolog 4 (S. cerevisiae) |
| 329 | BB006809 | 67260 | 1417781_at | longevity assurance homolog 4 (S. cerevisiae) |
| 330 | NM_026268 | 67603 | 1415834_at | dual specificity phosphatase 6 |
| 331 | BC021522 | 67636 | 1418996_a_at | RIKEN cDNA 4930469P12 gene |
| 332 | BC019530 | 67784 | 1451475_at | Plexin D1 |
| 333 | NM_026417 | 67864 | 1450418_a_at | RIKEN cDNA 2310034L04 gene |
| 334 | BC012247 | 67880 | 1419456_at | dicarbonyl L-xylulose reductase |
| 335 | BG074158 | 67896 | 1424186_at | RIKEN cDNA 2610001E17 gene |
| 336 | BB360604 | 67991 | 1429582_at | BTB (POZ) domain containing 14A |
| 337 | NM_026495 | 67991 | 1417153_at | BTB (POZ) domain containing 14A |
| 338 | NM_023422 | 68024 | 1418072_at | histone 1, H2bc |
| 339 | NM_024223 | 68337 | 1417311_at | cysteine rich protein 2 |
| 340 | AK003880 | 68647 | 1428902_at | RIKEN cDNA 1110020P09 gene |
| 341 | BB667130 | 68842 | 1434585_at | Tubby like protein 4 |
| 342 | BB174877 | 68897 | 1434795_at | dispatched homolog 1 (Drosophila) |
| 343 | BQ031098 | 69368 | 1435588_at | WD repeat and FYVE domain containing 1 |
| 344 | AF378762 | 69538 | 1451446_at | anthrax toxin receptor 1 |
| 345 | AK008491 | 69884 | 1454224_at | RIKEN cDNA 2010300F17 gene |
| 346 | AW986054 | 70110 | 1445897_s_at | interferon-induced protein 35 |
| 347 | AV171622 | 70152 | 1434150_a_at | RIKEN cDNA 3300001H21 gene |
| 348 | AV328634 | 70292 | 1436729_at | RIKEN cDNA 2600003E23 gene |
| 349 | BG072972 | 71566 | 1448251_at | RIKEN cDNA 9030425E11 gene |
| 350 | BB222846 | 72296 | 1434743_x_at | RUN and SH3 domain containing 1 |
| 351 | BG066866 | 73569 | 1430596_s_at | RIKEN cDNA 1700110N18 gene |
| 352 | BC025083 | 73690 | 1424927_at | GLI pathogenesis-related 1 (glioma) |
| 353 | BB463610 | 74041 | 1434240_at | RIKEN cDNA 4632434I11 gene |
| 354 | AI326880 | 74120 | 1447432_s_at | zinc finger protein 263 |
| 355 | AK005001 | 74159 | 1428236_at | acyl-Coenzyme A binding domain containing 5 |
| 356 | BF780807 | 74170 | 1434510_at | RIKEN cDNA 1810018P12 gene |
| 357 | AK014682 | 74608 | 1429909_at | RIKEN cDNA 4833411O04 gene |
| 358 | AK017926 | 74747 | 1428306_at | DNA-damage-inducible transcript 4 |
| 359 | BB765827 | 74761 | 1452330_a_at | RIKEN cDNA 1200013A08 gene |
| 360 | BC006820 | 75687 | 1424239_at | RIKEN cDNA 2310066E14 gene |
| 361 | BC025847 | 77419 | 1452351_at | RIKEN cDNA C030027K23 gene |
| 362 | BB767069 | 77757 | 1429722_at | RIKEN cDNA 9230111I22 gene |
| 363 | BB767069 | 77757 | 1453266_at | RIKEN cDNA 9230111I22 gene |
| 364 | AK007400 | 77889 | 1429088_at | limb-bud and heart |
| 365 | BE956581 | 78070 | 1435281_at | carnitine palmitoyltransferase 1c |
| 366 | BC023112 | 78752 | 1424431_at | chondroitin sulfate GalNAcT-2 |
| 367 | AB026551 | 80859 | 1417483_at | nuclear factor of kappa light polypeptide gene enhancer in B-cells inhibitor, zeta |
| 368 | BB524597 | 93691 | 1419355_at | Kruppel-like factor 7 (ubiquitous) |
| 369 | AV323203 | 99151 | 1435345_at | cerebral endothelial cell adhesion molecule 1 |
| 370 | BB621938 | 99382 | 1433453_a_at | expressed sequence AW539457 |
| 371 | C85065 | 102791 | 1420124_s_at | T-cell leukemia translocation altered gene |
| 372 | NM_134052 | 104923 | 1449076_x_at | expressed sequence AL024210 |
| 373 | BB458178 | 105501 | 1439259_x_at | abhydrolase domain containing 4 |
| 374 | NM_134076 | 105501 | 1416315_at | abhydrolase domain containing 4 |
| 375 | BQ032773 | 107351 | 1433742_at | ankyrin repeat domain 15 |
| 376 | BB449198 | 116914 | 1441315_s_at | solute carrier family 19 (thiamine transporter), member 2 |
| 377 | NM_054087 | 116914 | 1417902_at | solute carrier family 19 (thiamine transporter), member 2 |
| 378 | BB794673 | 140481 | 1435203_at | Mannosidase 2, alpha 2 |
| 379 | NM_138310 | 171504 | 1420382_at | apolipoprotein B48 receptor |
| 380 | AK011603 | 192197 | 1428454_at | breast carcinoma amplified sequence 3 |
| 381 | AW763751 | 192885 | 1435628_x_at | cDNA sequence BC005512 |
| 382 | BC022224 | 192970 | 1425704_at | cDNA sequence BC022224 |
| 383 | BF454057 | 207474 | 1440355_at | potassium channel tetramerisation domain containing 12b |
| 384 | BM245221 | 216198 | 1454646_at | RIKEN cDNA E430026E19 gene |
| 385 | AI647821 | 216233 | 1438470_at | suppressor of cytokine signaling 2 |
| 386 | BC022687 | 217887 | 1451533_at | cDNA sequence BC022687 |
| 387 | BM196656 | 223701 | 1434900_at | MKL (megakaryoblastic leukemia)/myocardin-like 1 |
| 388 | BC025476 | 223978 | 1426669_at | RIKEN cDNA C530044N13 gene |
| 389 | BM237031 | 227638 | 1435469_at | quiescin Q6-like 1 |
| 390 | AW123020 | 230657 | 1447966_a_at | RIKEN cDNA A630048M13 gene |
| 391 | BC025502 | 231532 | 1424842_a_at | Rho GTPase activating protein 24 |

TABLE 3-continued

203 Genes of Gene Set 3: Upregulated in Asymmetric Self-Renewal

| SEQ ID NO: | GenBank ID | Locus Link | Affy ID | Gene name |
|---|---|---|---|---|
| 392 | BC025600 | 231633 | 1451344_at | cDNA sequence BC025600 |
| 393 | BB027759 | 231997 | 1433481_at | FK506 binding protein 14 |
| 394 | BC014685 | 232086 | 1424726_at | cDNA sequence BC014685 |
| 395 | BC027150 | 232146 | 1424652_at | cDNA sequence BC014699 |
| 396 | BB530515 | 246154 | 1455812_x_at | Slit-like 2 (*Drosophila*) |
| 397 | AF305427 | 252967 | 1423959_at | ropporin 1-like |
| 398 | BB466171 | 268857 | 1458148_at | RIKEN cDNA D230007K08 gene |
| 399 | BG244780 | 278757 | 1436330_x_at | similar to hypothetical protein 6720451E15 |
| 400 | AV297651 | 319162 | 1435866_s_at | histone 3, H2a |
| 401 | AK009255 | 320244 | 1452890_at | RIKEN cDNA D630041K24 gene |
| 402 | BB610454 | 320415 | 1435750_at | GTP cyclohydrolase I feedback regulator |
| 403 | BB536078 | 329628 | 1459749_s_at | RIKEN cDNA 6030410K14 gene |
| 404 | BB748934 | 381110 | 1438035_at | expressed sequence AW061290 |
| 405 | BB748934 | 381110 | 1438036_x_at | expressed sequence AW061290 |
| 406 | AV352121 | 414107 | 1442002_at | RIKEN cDNA 7030402D04 gene |
| 407 | NM_033174 | 20646 /// 84704 | 1421063_s_at | small nuclear ribonucleoprotein N /// SNRPN upstream reading frame |
| 408 | U94828 | | 1426037_a_at | gb: U94828.1 /DB_XREF = gi: 2605641 /GEN = RGS-r /FEA = FLmRNA /CNT = 1 /TID = Mm.181709.2 /TIER = FL /STK = 1 /UG = Mm.181709 /LL = 19734 /DEF = *Mus musculus* retinally abundant regulator of G-protein signaling mRGS-r (RGS-r) mRNA, complete cds. /PROD = retinally abundant regulator of G-proteinsignaling mRGS-r /FL = gb: U94828.1 |
| 409 | BG065754 | | 1450017_at | gb: BG065754 /DB_XREF = gi: 12548317 /DB_XREF = H3034H06-3 /CLONE = H3034H06 /FEA = FLmRNA /CNT = 268 /TID = Mm.2103.1 /TIER = Stack /STK = 9 /UG = Mm.2103 /LL = 12450 /UG_GENE = Ccng /UG_TITLE = cyclin G /FL = gb: BC005534.1 gb: L49507.1 gb: NM_009831.1 |
| 410 | BG065754 | | 1420827_a_at | gb: BG085921 /DB_XREF = gi: 12568485 /DB_XREF = H3119F08-5 /CLONE = H3119F08 /FEA = FLmRNA /CNT = 268 /TID = Mm.2103.1 /TIER = ConsEnd /STK = 0 /UG = Mm.2103 /LL = 12450 /UG_GENE = Ccng /UG_TITLE = cyclin G /FL = gb: BC005534.1 gb: L49507.1 gb: NM_009831.1 |
| 411 | C85657 | | 1428909_at | gb: BI683916 /DB_XREF = gi: 15646544 /DB_XREF = 603306739F1 /CLONE = IMAGE: 5342792 /FEA = mRNA /CNT = 131 /TID = Mm.22482.1 /TIER = Stack /STK = 12 /UG = Mm.22482 /LL = 71739 /UG_GENE = 1200015M12Rik /UG_TITLE = RIKEN cDNA 1200015M12 gene |
| 412 | NM_009148 | | 1422684_a_at | gb: NM_009148.1 /DB_XREF = gi: 6677902 /GEN = Sec8 /FEA = FLmRNA /CNT = 86 /TID = Mm.6925.1 /TIER = FL + Stack /STK = 19 /UG = Mm.6925 /LL = 20336 /DEF = *Mus musculus* SEC8 (*S. cerevisiae*) (Sec8), mRNA. /PROD = SEC8 (*S. cerevisiae*) /FL = gb: NM_009148.1 gb: AF022962.1 |
| 413 | BI134721 | | 1438672_at | CDNA, clone: Y1G0115A05, strand: unspecified |

TABLE 3-continued

203 Genes of Gene Set 3: Upregulated in Asymmetric Self-Renewal

| SEQ ID NO: | GenBank ID | Locus Link | Affy ID | Gene name |
|---|---|---|---|---|
| 414 | AI837704 | | 1436188_a_at | gb: AI837704 /DB_XREF = gi: 5471917 /DB_XREF = UI-M-AK0-adj-e-01-0-UI.s1 /CLONE = UI-M-AK0-adj-e-01-0-UI /FEA = EST /CNT = 16 /TID = Mm.29846.2 /TIER = Stack /STK = 10 /UG = Mm.29846 /UG_TITLE = *Mus musculus*, Similar to NDRG family, member 4, clone MGC: 7067 IMAGE: 3156802, mRNA, complete cds |
| 415 | BG063749 | | 1429089_s_at | gb: BG063749 /DB_XREF = gi: 12546400 /DB_XREF = H3012C11-3 /CLONE = H3012C11 /FEA = mRNA /CNT = 38 /TID = Mm.36757.1 /TIER = Stack /STK = 12 /UG = Mm.36757 /LL = 72944 /UG_GENE = 2900026A02Rik /UG_TITLE = RIKEN cDNA 2900026A02 gene |
| 416 | BB820441 | | 1458299_s_at | gb: BB820441 /DB_XREF = gi: 16993070 /DB_XREF = BB820441 /CLONE = G830005J05 /FEA = EST /CNT = 3 /TID = Mm.214145.1 /TIER = ConsEnd /STK = 3 /UG = Mm.214145 /UG_TITLE = ESTs |
| 417 | BQ086474 | | 1439794_at | Transcribed locus |
| 418 | NM_011722 | | 1416499_a_at | gb: NM_011722.1 /DB_XREF = gi: 6756008 /GEN = Dctn6 /FEA = FLmRNA /CNT = 129 /TID = Mm.90496.1 /TIER = FL + Stack /STK = 85 /UG = Mm.90496 /LL = 22428 /DEF = *Mus musculus* dynactin 6 (Dctn6), mRNA. /PROD = dynactin 6 /FL = gb: AF124788.1 gb: NM_011722.1 gb: AF190796.1 |

TABLE 4

186 Genes of Gene Set 4: Upregulated in Symmetric Self-Renewal

| SEQ ID NO: | GenBank ID | Locus Link | Affy ID | Gene name |
|---|---|---|---|---|
| 419 | NM_009626 | 11529 | 1450110_at | alcohol dehydrogenase 7 (class IV), mu or sigma polypeptide |
| 420 | AA823938 | 11740 | 1430542_a_at | solute carrier family 25 (mitochondrial carrier, adenine nucleotide translocator), member 5 |
| 421 | BC006646 | 12224 | 1451739_at | Kruppel-like factor 5 |
| 422 | X75483 | 12428 | 1417911_at | cyclin A2 |
| 423 | NM_009841 | 12475 | 1417268_at | CD14 antigen |
| 424 | NM_009860 | 12532 | 1422252_a_at | cell division cycle 25 homolog C (*S. cerevisiae*) |
| 425 | BF467211 | 12540 | 1435807_at | cell division cycle 42 homolog (*S. cerevisiae*) |
| 426 | BB129366 | 12660 | 1453582_at | choline kinase alpha |
| 427 | AK004908 | 13052 | 1452391_at | coxsackievirus and adenovirus receptor |
| 428 | L25126 | 13205 | 1416467_at | DEAD/H (Asp-Glu-Ala-Asp/His) box polypeptide 3, X-linked |
| 429 | BB393998 | 14156 | 1436454_x_at | flap structure specific endonuclease 1 |
| 430 | BI684556 | 14211 | 1429658_a_at | SMC2 structural maintenance of chromosomes 2-like 1 (yeast) |
| 431 | BI684556 | 14211 | 1429660_s_at | SMC2 structural maintenance of chromosomes 2-like 1 (yeast) |
| 432 | BI684556 | 14211 | 1429659_at | SMC2 structural maintenance of chromosomes 2-like 1 (yeast) |
| 433 | BB451746 | 15115 | 1438510_a_at | histidyl-tRNA synthetase |
| 434 | NM_008253 | 15354 | 1416155_at | high mobility group box 3 |
| 435 | AV377334 | 15365 | 1440559_at | high mobility group AT-hook 2, pseudogene 1 |

TABLE 4-continued

186 Genes of Gene Set 4: Upregulated in Symmetric Self-Renewal

| SEQ ID NO: | GenBank ID | Locus Link | Affy ID | Gene name |
|---|---|---|---|---|
| 436 | AK020144 | 15366 | 1429871_at | hyaluronan mediated motility receptor (RHAMM) |
| 437 | BE956180 | 15456 | 1456880_at | Human papillomavirus 18 E5 central sequence motif gene 2 |
| 438 | AA543265 | 15526 | 1431274_a_at | heat shock protein, A |
| 439 | BB105998 | 15569 | 1421883_at | ELAV (embryonic lethal, abnormal vision, *Drosophila*)-like 2 (Hu antigen B) |
| 440 | BB105998 | 15569 | 1421882_a_at | ELAV (embryonic lethal, abnormal vision, *Drosophila*)-like 2 (Hu antigen B) |
| 441 | BB533736 | 16007 | 1442340_x_at | cysteine rich protein 61 |
| 442 | BB533736 | 16007 | 1457823_at | cysteine rich protein 61 |
| 443 | BI410774 | 16319 | 1423093_at | inner centromere protein |
| 444 | NM_010594 | 16483 | 1415968_a_at | kidney androgen regulated protein |
| 445 | BB827235 | 16551 | 1452315_at | kinesin family member 11 |
| 446 | BB827235 | 16551 | 1452314_at | kinesin family member 11 |
| 447 | BE199508 | 16561 | 1451642_at | kinesin family member 1B |
| 448 | BC010581 | 16765 | 1448113_at | stathmin 1 |
| 449 | AA270173 | 16906 | 1423520_at | lamin B1 |
| 450 | BI249188 | 17184 | 1441272_at | Matrin 3 |
| 451 | BB444511 | 17184 | 1458508_at | matrin 3 |
| 452 | BG073178 | 17318 | 1438239_at | RIKEN cDNA C230067J06 gene |
| 453 | NM_008697 | 18080 | 1419078_at | ninein |
| 454 | AW552076 | 18458 | 1441177_at | Poly A binding protein, cytoplasmic 1 |
| 455 | BB480970 | 18514 | 1440037_at | Pre B-cell leukemia transcription factor 1 |
| 456 | BB589989 | 18536 | 1431287_at | pericentriolar material 1 |
| 457 | BC023427 | 18591 | 1450413_at | platelet derived growth factor, B polypeptide |
| 458 | BM230222 | 18789 | 1455836_at | poly (A) polymerase alpha |
| 459 | AV135835 | 18949 | 1423325_at | pinin |
| 460 | NM_008893 | 18969 | 1448369_at | polymerase (DNA directed), alpha 2 |
| 461 | AI426862 | 19290 | 1456898_at | Purine rich element binding protein A |
| 462 | NM_009004 | 19348 | 1449207_a_at | kinesin family member 20A |
| 463 | NM_011231 | 19352 | 1419553_a_at | RAB geranylgeranyl transferase, b subunit |
| 464 | U27178 | 19650 | 1425166_at | Retinoblastoma-like 1 (p107) |
| 465 | BM218282 | 19653 | 1437322_at | RNA binding motif protein 4 |
| 466 | BB474427 | 19726 | 1441253_at | Regulatory factor X, 3 (influences HLA class II expression) |
| 467 | AJ238396 | 19893 | 1427467_a_at | retinitis pigmentosa GTPase regulator |
| 468 | BB640315 | 20300 | 1458277_at | Chemokine (C-C motif) ligand 25 |
| 469 | NM_009171 | 20425 | 1422198_a_at | serine hydroxymethyl transferase 1 (soluble) |
| 470 | BB357585 | 20512 | 1426341_at | solute carrier family 1 (glial high affinity glutamate transporter), member 3 |
| 471 | AK021174 | 20937 | 1432236_a_at | suppressor of variegation 3-9 homolog 1 (*Drosophila*) |
| 472 | BB787809 | 21335 | 1455834_x_at | transforming, acidic coiled-coil containing protein 3 |
| 473 | BB749838 | 21973 | 1442454_at | Topoisomerase (DNA) II alpha |
| 474 | BM232388 | 22003 | 1456623_at | tropomyosin 1, alpha |
| 475 | BB810450 | 22042 | 1422967_a_at | transferrin receptor |
| 476 | BB810450 | 22042 | 1422966_a_at | transferrin receptor |
| 477 | BB125985 | 22289 | 1446234_at | Ubiquitously transcribed tetratricopeptide repeat gene, X chromosome |
| 478 | NM_011793 | 23825 | 1421081_a_at | barrier to autointegration factor 1 |
| 479 | NM_011793 | 23825 | 1421083_x_at | barrier to autointegration factor 1 |
| 480 | NM_011793 | 23825 | 1421082_s_at | barrier to autointegration factor 1 |
| 481 | NM_011905 | 24088 | 1419132_at | toll-like receptor 2 |
| 482 | BB535888 | 26932 | 1452788_at | protein phosphatase 2, regulatory subunit B (B56), epsilon isoform |
| 483 | AF461135 | 27494 | 1425907_s_at | angiomotin |
| 484 | BB315904 | 29808 | 1422646_at | MAX gene associated |
| 485 | NM_013864 | 29811 | 1448154_at | N-myc downstream regulated gene 2 |
| 486 | AV003424 | 51788 | 1438091_a_at | H2A histone family, member Z |
| 487 | BG070871 | 51869 | 1437179_at | Rap1 interacting factor 1 homolog (yeast) |
| 488 | BQ174391 | 51938 | 1436581_at | DNA segment, Chr 3, ERATO Doi 789, expressed |
| 489 | BM251033 | 51944 | 1442280_at | DNA segment, Chr 2, ERATO Doi 750, expressed |
| 490 | NM_023209 | 52033 | 1448627_s_at | PDZ binding kinase |

TABLE 4-continued

186 Genes of Gene Set 4: Upregulated in Symmetric Self-Renewal

| SEQ ID NO: | GenBank ID | Locus Link | Affy ID | Gene name |
|---|---|---|---|---|
| 491 | AK018652 | 52036 | 1454030_at | DNA segment, Chr 19, ERATO Doi 703, expressed |
| 492 | BB492440 | 52563 | 1460549_a_at | CDC23 (cell division cycle 23, yeast, homolog) |
| 493 | AV356898 | 52696 | 1444717_at | ZW10 interactor |
| 494 | BG091626 | 55935 | 1438700_at | Formin binding protein 4 |
| 495 | AK012900 | 55947 | 1432097_a_at | DNA cross-link repair 1A, PSO2 homolog (S. cerevisiae) |
| 496 | AW046403 | 56070 | 1450100_a_at | transcription elongation regulator 1 (CA150) |
| 497 | AW557777 | 56070 | 1434434_s_at | transcription elongation regulator 1 (CA150) |
| 498 | AW046403 | 56070 | 1421033_a_at | transcription elongation regulator 1 (CA150) |
| 499 | AV337624 | 58212 | 1442421_at | RIKEN cDNA 2900083I11 gene |
| 500 | AV114800 | 59025 | 1439201_at | ubiquitin specific protease 14 |
| 501 | AK010892 | 66307 | 1425050_at | RIKEN cDNA 2610034N03 gene |
| 502 | BF730671 | 66317 | 1434433_x_at | RIKEN cDNA 2700038L12 gene |
| 503 | AK012015 | 66583 | 1453359_at | exosome component 1 |
| 504 | BG277020 | 66625 | 1453185_at | RIKEN cDNA 5730406M06 gene |
| 505 | BG277020 | 66625 | 1429537_at | RIKEN cDNA 5730406M06 gene |
| 506 | BB451779 | 66690 | 1439726_at | RIKEN cDNA 4432406C05 gene |
| 507 | NM_024194 | 67144 | 1448720_at | RIKEN cDNA 2610040E16 gene |
| 508 | NM_026404 | 67843 | 1416110_at | solute carrier family 35, member A4 |
| 509 | AW494906 | 68539 | 1416033_at | RIKEN cDNA 1110006I15 gene |
| 510 | BG072267 | 68585 | 1439650_at | reticulon 4 |
| 511 | BB818617 | 68857 | 1441178_at | RIKEN cDNA 1190002H09 gene |
| 512 | AV325310 | 69860 | 1455341_at | RIKEN cDNA 2010003J03 gene |
| 513 | AU043467 | 69928 | 1453067_at | RIKEN cDNA 2610040C18 gene |
| 514 | BM244144 | 70099 | 1441677_at | SMC4 structural maintenance of chromosomes 4-like 1 (yeast) |
| 515 | AI317200 | 70480 | 1431347_at | RIKEN cDNA 5730407M17 gene |
| 516 | AK014419 | 70699 | 1430343_at | nucleoporin 205 |
| 517 | NM_080636 | 70791 | 1419158_a_at | histidyl-tRNA synthetase-like |
| 518 | BC023403 | 70808 | 1419612_at | RIKEN cDNA 4632415L05 gene |
| 519 | BI738328 | 71514 | 1436898_at | splicing factor proline/glutamine rich (polypyrimidine tract binding protein associated) |
| 520 | BC027408 | 71683 | 1423878_at | glycophorin C |
| 521 | AV373814 | 72504 | 1435303_at | TAF4B RNA polymerase II, TATA box binding protein (TBP)-associated factor |
| 522 | BM293412 | 72505 | 1438429_at | RIKEN cDNA 2610319H10 gene |
| 523 | AK006582 | 73316 | 1453233_s_at | calreticulin 3 |
| 524 | AK020079 | 74035 | 1432218_a_at | RIKEN cDNA 4632412I24 gene |
| 525 | AV126179 | 74107 | 1453683_a_at | RIKEN cDNA 1200008O12 gene |
| 526 | BC025160 | 74143 | 1418768_at | optic atrophy 1 homolog (human) |
| 527 | BB104271 | 75710 | 1456964_at | RNA binding motif protein 12 |
| 528 | AK012883 | 75739 | 1432216_s_at | membrane protein, palmitoylated 7 (MAGUK p55 subfamily member 7) |
| 529 | AK013903 | 76846 | 1426958_at | ribosomal protein S9 |
| 530 | BC024637 | 76899 | 1431120_a_at | golgi autoantigen, golgin subfamily a, 1 |
| 531 | BB392503 | 77715 | 1440163_at | RIKEN cDNA 6030490B17 gene |
| 532 | BB501662 | 77987 | 1457900_at | activating signal cointegrator 1 complex subunit 3 |
| 533 | BM219644 | 78656 | 1452350_at | bromodomain containing 8 |
| 534 | BM219644 | 78656 | 1427192_a_at | bromodomain containing 8 |
| 535 | BG069311 | 78658 | 1434426_at | RIKEN cDNA B130055D15 gene |
| 536 | BB494601 | 78833 | 1453050_at | RIKEN cDNA 2700085M18 gene |
| 537 | AV251959 | 94212 | 1456403_at | phosphoprotein associated with glycosphingolipid-enriched microdomains |
| 538 | BC005738 | 94242 | 1417109_at | lipocalin 7 |
| 539 | BB549997 | 98388 | 1426620_at | carbohydrate sulfotransferase 10 |
| 540 | BI151331 | 101757 | 1433935_at | expressed sequence AU020206 |
| 541 | BG074683 | 108062 | 1455523_at | Cleavage stimulation factor, 3' pre-RNA subunit 2 |
| 542 | BB046659 | 109037 | 1442933_at | RIKEN cDNA 6230415M23 gene |
| 543 | BB150663 | 109237 | 1459302_at | RIKEN cDNA A030007N12 gene |
| 544 | NM_053261 | 114663 | 1418665_at | inositol (myo)-1(or 4)-monophosphatase 2 |
| 545 | BM233196 | 116940 | 1421905_at | nuclear receptor coactivator 6 interacting protein |
| 546 | BB036922 | 208606 | 1442083_at | RIKEN cDNA 1500011J06 gene |

TABLE 4-continued

186 Genes of Gene Set 4: Upregulated in Symmetric Self-Renewal

| SEQ ID NO: | GenBank ID | Locus Link | Affy ID | Gene name |
|---|---|---|---|---|
| 547 | BM249388 | 208836 | 1427953_at | cDNA sequence BC025462 |
| 548 | AW457809 | 209584 | 1435728_at | RIKEN cDNA 5230400J09 gene |
| 549 | BB252670 | 212919 | 1440168_x_at | potassium channel tetramerisation domain containing 7 |
| 550 | BE951628 | 217653 | 1434767_at | expressed sequence C79407 |
| 551 | BB540053 | 217653 | 1458374_at | expressed sequence C79407 |
| 552 | BM224404 | 218503 | 1442453_at | RIKEN cDNA 5832424M12 gene |
| 553 | BG069610 | 223455 | 1445928_at | RIKEN cDNA F830029L24 gene |
| 554 | BM240080 | 225131 | 1437426_at | WW domain containing adaptor with coiled-coil |
| 555 | BC021497 | 225348 | 1451087_at | WD repeat domain 36 |
| 556 | BC013717 | 225363 | 1424013_at | eukaryotic translation termination factor 1 |
| 557 | C77379 | 225363 | 1420024_s_at | eukaryotic translation termination factor 1 |
| 558 | BE456272 | 225888 | 1442764_at | suppressor of variegation 4-20 homolog 1 (*Drosophila*) |
| 559 | BG068387 | 229841 | 1439040_at | centromere protein E |
| 560 | BG094881 | 229905 | 1455991_at | cysteine conjugate-beta lyase 2 |
| 561 | AF367244 | 230233 | 1424142_at | inhibitor of kappa light polypeptide enhancer in B-cells, kinase complex-associated protein |
| 562 | BE688816 | 231769 | 1434966_at | splicing factor, arginine/serine-rich 8 |
| 563 | BE985138 | 233908 | 1455831_at | fusion, derived from t(12; 16) malignant liposarcoma (human) |
| 564 | BB770972 | 237436 | 1437244_at | Growth arrest-specific 2 like 3 |
| 565 | BM116906 | 239985 | 1456659_at | AT rich interactive domain 1B (Swi1 like) |
| 566 | BM239553 | 240641 | 1440924_at | M-phase phosphoprotein 1 |
| 567 | BM121082 | 240660 | 1435452_at | transmembrane protein 20 |
| 568 | BB470898 | 268656 | 1436727_x_at | serine palmitoyltransferase, long chain base subunit 1 |
| 569 | NM_007629 | 268697 | 1416076_at | cyclin B1 |
| 570 | AI528781 | 268996 | 1419361_at | synovial sarcoma translocation, Chromosome 18 |
| 571 | BB296225 | 319517 | 1457218_at | RIKEN cDNA 6430510M02 gene |
| 572 | BB456871 | 319524 | 1458941_at | RIKEN cDNA D130016B08 gene |
| 573 | BQ177743 | 319602 | 1435136_at | RIKEN cDNA C130020C13 gene |
| 574 | BQ177743 | 319602 | 1455228_at | RIKEN cDNA C130020C13 gene |
| 575 | BB490889 | 321022 | 1440332_at | Carnitine deficiency-associated gene expressed in ventricle 3 |
| 576 | AA189481 | 328425 | 1456145_at | Deleted in lymphocytic leukemia, 2 |
| 577 | BC004768 | 381280 | 1451456_at | RIKEN cDNA 6430706D22 gene |
| 578 | AK012880 | 381598 | 1429882_at | RIKEN cDNA 2610005L07 gene |
| 579 | AK013425 | 381760 | 1430294_at | single-stranded DNA binding protein 1 |
| 580 | C81442 | 11740 /// 433326 | 1438545_at | solute carrier family 25 (mitochondrial carrier, adenine nucleotide translocator), member 5 /// similar to SLC25A5 protein |
| 581 | NM_008989 | 19290 /// 70733 | 1420628_at | purine rich element binding protein A /// RIKEN cDNA 6330411E07 gene |
| 582 | NM_020506 | 50523 /// 57258 | 1421055_at | large tumor suppressor 2 /// exportin 4 |
| 583 | BI654939 | 68827 /// 69967 | 1431235_at | RIKEN cDNA 1110061A14 gene /// RIKEN cDNA 2810017I02 gene |
| 584 | AK012048 | | 1429268_at | gb: AK012048.1 /DB_XREF = gi: 12848545 /FEA = mRNA /CNT = 24 /TID = Mm.45237.1 /TIER = Stack /STK = 8 /UG = Mm.45237 /LL = 70458 /UG_GENE = 2610318N02Rik /UG_TITLE = RIKEN cDNA 2610318N02 gene /DEF = *Mus musculus* 10 days embryo whole body cDNA, RIKEN full-length enriched library, clone: 2610318N02: hypothetical protein, full insert sequence. |

TABLE 4-continued

186 Genes of Gene Set 4: Upregulated in Symmetric Self-Renewal

| SEQ ID NO: | GenBank ID | Locus Link | Affy ID | Gene name |
|---|---|---|---|---|
| 585 | BB335087 | | 1437372_at | gb: BB335087 /DB_XREF = gi: 15411581 /DB_XREF = BB335087 /CLONE = B830031K20 /FEA = EST /CNT = 22 /TID = Mm.132502.1 /TIER = Stack /STK = 19 /UG = Mm.132502 /UG_TITLE = ESTs, Weakly similar to S57447 HPBRII-7 protein (*H. sapiens*) |
| 586 | BB377034 | | 1439188_at | gb: BB377034 /DB_XREF = gi: 16407575 /DB_XREF = BB377034 /CLONE = C130087M08 /FEA = EST /CNT = 14 /TID = Mm.137415.1 /TIER = Stack /STK = 8 /UG = Mm.137415 /UG_TITLE = ESTs |
| 587 | BB463474 | | 1458902_at | 12 days embryo spinal ganglion cDNA, RIKEN full-length enriched library, clone: D130080L18 product: unclassifiable, full insert sequence |
| 588 | BB209183 | | 1456077_x_at | gb: BB209183 /DB_XREF = gi: 8874136 /DB_XREF = BB209183 /CLONE = A430091G17 /FEA = EST /CNT = 18 /TID = Mm.129698.1 /TIER = Stack /STK = 17 /UG = Mm.129698 /UG_TITLE = ESTs |
| 589 | BB034567 | | 1435584_at | Transcribed locus |
| 590 | AF156549 | | 1452013_at | gb: AF156549.1 /DB_XREF = gi: 6457269 /FEA = FLmRNA /CNT = 67 /TID = Mm.80501.1 /TIER = FL + Stack /STK = 8 /UG = Mm.80501 /LL = 11982 /UG_GENE = Atp10a /DEF = *Mus musculus* putative E1-E2 ATPase mRNA, complete cds. /PROD = putative E1-E2 ATPase /FL = gb: AF156549.1 |
| 591 | AK013239 | | 1453596_at | gb: AK013239.1 /DB_XREF = gi: 12850478 /GEN = Idb2 /FEA = mRNA /CNT = 10 /TID = Mm.1466.2 /TIER = ConsEnd /STK = 1 /UG = Mm.1466 /LL = 15902 /UG_TITLE = inhibitor of DNA binding 2 /DEF = *Mus musculus* 10, 11 days embryo whole body cDNA, RIKEN full-length enriched library, clone: 2810434H03: inhibitor of DNA binding 2, full insert sequence. |
| 592 | BC004622 | | 1424843_a_at | gb: BC004622.1 /DB_XREF = gi: 13435499 /FEA = FLmRNA /CNT = 24 /TID = Mm.35844.2 /TIER = FL + Stack /STK = 14 /UG = Mm.35844 /LL = 14455 /UG_GENE = Gas5 /DEF = *Mus musculus*, Similar to growth arrest specific 5, clone MGC: 6251 IMAGE: 3585621, mRNA, complete cds. /PROD = Similar to growth arrest specific 5 /FL = gb: BC004622.1 |
| 593 | BI793514 | | 1437491_at | gb: BI793514 /DB_XREF = gi: 15821231 /DB_XREF = ic39f09.x1 /CLONE = IMAGE: 5656096 /FEA = EST /CNT = 24 /TID = Mm.197387.2 /TIER = Stack /STK = 17 /UG = Mm.197387 /LL = 76895 /UG_GENE = Bicd2 /UG_TITLE = bicaudal D homolog 2 (*Drosophila*) |

TABLE 4-continued

186 Genes of Gene Set 4: Upregulated in Symmetric Self-Renewal

| SEQ ID NO: | GenBank ID | Locus Link | Affy ID | Gene name |
|---|---|---|---|---|
| 594 | NM_007850 | | 1422802_at | gb: NM_007850.1 /DB_XREF = gi: 13937344 /GEN = Defcr3 /FEA = FLmRNA /CNT = 25 /TID = Mm.175392.1 /TIER = FL + Stack /STK = 11 /UG = Mm.175392 /LL = 13237 /DEF = *Mus musculus* defensin related cryptdin 3 (Defcr3), mRNA. /PROD = defensin related cryptdin 3 /FL = gb: NM_007850.1 |
| 595 | AW540070 | | 1419967_at | gb: AW540070 /DB_XREF = gi: 7182487 /DB_XREF = C0128B09-3 /CLONE = C0128B09 /FEA = EST /CNT = 1 /TID = Mm.219517.1 /TIER = ConsEnd /STK = 0 /UG = Mm.219517 /LL = 107046 /UG_GENE = AW540070 /UG_TITLE = expressed sequence AW540070 |
| 596 | BB622498 | | 1438714_at | gb: BB622498 /DB_XREF = gi: 16461523 /DB_XREF = BB622498 /CLONE = 6430408J18 /FEA = EST /CNT = 21 /TID = Mm.12236.4 /TIER = Stack /STK = 9 /UG = Mm.12236 /LL = 22680 /UG_GENE = Zfp207 /UG_TITLE = zinc finger protein 207 |
| 597 | BB207248 | | 1443798_at | gb: BB207248 /DB_XREF = gi: 8872201 /DB_XREF = BB207248 /CLONE = A430080K21 /FEA = EST /CNT = 3 /TID = Mm.131916.1 /TIER = ConsEnd /STK = 3 /UG = Mm.131916 /UG_TITLE = ESTs |
| 598 | BG072612 | | 1445178_at | gb: BG072612 /DB_XREF = gi: 12555181 /DB_XREF = H3112H07-3 /CLONE = H3112H07 /FEA = EST /CNT = 3 /TID = Mm.182596.1 /TIER = ConsEnd /STK = 2 /UG = Mm.182596 /UG_TITLE = ESTs |
| 599 | C80049 | | 1420172_at | gb: C80049 /DB_XREF = gi: 2520379 /DB_XREF = C80049 /CLONE = J0075G08 /FEA = EST /CNT = 1 /TID = Mm.219481.1 /TIER = ConsEnd /STK = 0 /UG = Mm.219481 /LL = 97972 /UG_GENE = C80049 /UG_TITLE = expressed sequence C80049 |
| 600 | BG070740 | | 1433640_at | gb: BG070740 /DB_XREF = gi: 12553309 /DB_XREF = H3090F06-3 /CLONE = H3090F06 /FEA = EST /CNT = 123 /TID = Mm.25703.3 /TIER = Stack /STK = 78 /UG = Mm.25703 /LL = 51886 /UG_GENE = D3Ertd330e /UG_TITLE = DNA segment, Chr 3, ERATO Doi 330, expressed |
| 601 | BB711506 | | 1437878_s_at | gb: BB711506 /DB_XREF = gi: 16064675 /DB_XREF = BB711506 /CLONE = B020024M07 /FEA = EST /CNT = 26 /TID = Mm.26219.3 /TIER = Stack /STK = 13 /UG = Mm.26219 /LL = 67535 /UG_GENE = 4921507O14Rik /UG_TITLE = RIKEN cDNA 4921507O14 gene |

TABLE 4-continued

186 Genes of Gene Set 4: Upregulated in Symmetric Self-Renewal

| SEQ ID NO: | GenBank ID | Locus Link | Affy ID | Gene name |
|---|---|---|---|---|
| 602 | AV110626 | | 1450838_x_at | gb: AV110626 /DB_XREF = gi: 5264706 /DB_XREF = AV110626 /CLONE = 2600013F04 /FEA = FLmRNA /CNT = 241 /TID = Mm.10474.1 /TIER = Stack /STK = 231 /UG = Mm.10474 /LL = 67281 /UG_GENE = 3110005M08Rik /UG_TITLE = RIKEN cDNA 3110005M08 gene /FL = gb: NM_026069.1 |
| 603 | BM213851 | | 1437570_at | gb: BM213851 /DB_XREF = gi: 17771862 /DB_XREF = C0842E05-3 /CLONE = C0842E05 /FEA = EST /CNT = 23 /TID = Mm.31113.1 /TIER = Stack /STK = 16 /UG = Mm.31113 /LL = 103762 /UG_GENE = AI503301 /UG_TITLE = expressed sequence AI503301 |
| 604 | BF020847 | | 1444318_at | gb: BF020847 /DB_XREF = gi: 10752179 /DB_XREF = uw69d01.x1 /CLONE = IMAGE: 3467233 /FEA = EST /CNT = 5 /TID = Mm.86694.1 /TIER = ConsEnd /STK = 2 /UG = Mm.86694 /UG_TITLE = ESTs |

TABLE 5

Mouse genes associated with asymmetric self-renewal (Preferred choices)

| SEQ ID NO: | GenBank ID | Gene name | Description | Affy ID | Features |
|---|---|---|---|---|---|
| 29; 270 | NM_008714 | Notch1 | Notch gene homolog 1 (*Drosophila*) | 1418633_at | Associated with Chromosome 2 |
| 61 | BB559706 | Plxdc2 | plexin domain containing 2 | 1418912_at | Associated with Chromosome 2 |
| 65 | AK005731 | 1700007K13Rik | RIKEN cDNA 1700007K13 gene | 1428705_at | Associated with Chromosome 2 |
| 87 | BB131106 | Garnl3 | GTPase activating RANGAP domain-like 3 | 1433553_at | Associated with Chromosome 2 |
| 105 | BB196807 | Slc2a6 | solute carrier family 2 (facilitated glucose transporter), member 6 | 1434015_at | Associated with Chromosome 2 |
| 99 | BI217574 | Sardh | Sarcosine dehydrogenase | 1448426_at | Associated with Chromosome 2 |
| 93 | BC024599 | 2810003C17Rik | RIKEN cDNA 2810003C17 gene | 1451287_s_at | Associated with Chromosome 2 |
| 51 | NM_012043 | Islr | immunoglobulin superfamily containing leucine-rich repeat | 1418450_at | |
| 18 | NM_008026 | Fli1 | Friend leukemia integration 1 | 1422024_at | |
| 83 | NM_030712 | Cxcr6 | chemokine (C—X—C motif) receptor 6 | 1422812_at | |

TABLE 5-continued

Mouse genes associated with asymmetric self-renewal (Preferred choices)

| SEQ ID NO: | GenBank ID | Gene name | Description | Affy ID | Features |
|---|---|---|---|---|---|
| 115 | BF457736 | A730041O15Rik | RIKEN cDNA A730041O15 gene | 1434762_at | |
| 141 | BE981473 | 4930535B03Rik | RIKEN cDNA 4930535B03 gene | 1437641_at | |
| 88 | BB009770 | MGC30332 | hypothetical protein MGC30332 | 1441880_x_at | |
| 94 | BB049759 | 6530418L21Rik | RIKEN cDNA 6530418L21 gene | 1444723_at | |
| 70 | AU020235 | Sulf2 | sulfatase 2 | 1447602_x_at | |
| 64 | BC019937 | 1110038M16Rik | RIKEN cDNA 1110038M16 gene | 1451479_a_at | |
| 74 | BC026495 | 4930430E16Rik | RIKEN cDNA 4930430E16 gene | 1451653_a_at | |
| 63 | AW259452 | 1110033O09Rik | RIKEN cDNA 1110033O09 gene | 1452875_at | |
| 116 | BB215355 | Wdr59 | WD repeat domain 59 | 1456638_at | |
| | BB196807 | Slc2a6 | solute carrier family 2 (facilitated glucose transporter), member 6 | 1434015_at | |

The following 7 murine genes are exclusively associated with asymmetric self renewal and are located on Chromosome 2: NM_008714; BB559706; AK005731; BB131106; BB196807; BI217574; and BC024599.

The following 13 murine genes are exclusively associated with asymmetric self renewal and are NOT located on Chromosome 2: NM_012043; NM_008026; NM_030712; BF457736; BE981473; BB009770; BB049759; AU020235; BC019937; BC026495; AW259452; BB215355; and BB196807.

TABLE 6

Human genes associated with asymmetric self-renewal (Preferred choices)

| SEQ ID NO: | GenBank ID | Gene name | Description | Affy ID | Features |
|---|---|---|---|---|---|
| 605 | AF308602 | | | 1418633_at | Mouse homologue on Chromosome 2 |
| 606 | AI264121 | | | 1418912_at | Mouse homologue on Chromosome 2 |
| 607 | AU160041 | | | 1428705_at | Mouse homologue on Chromosome 2 |
| 608 | AL136573 | GARNL3 | GTPase activating Rap/RanGAP domain-like 3 | 1433553_at | Mouse homologue on Chromosome 2 |
| 609 | NM_017585 | SLC2A6 | solute carrier family 2 (facilitated glucose transporter), member 6 | 1434015_at | Mouse homologue on Chromosome 2 |

TABLE 6-continued

Human genes associated with asymmetric self-renewal (Preferred choices)

| SEQ ID NO: | GenBank ID | Gene name | Description | Affy ID | Features |
|---|---|---|---|---|---|
| 610 | AF047004 | SARDH | sarcosine dehydrogenase | 1448426_at | Mouse homologue on Chromosome 2 |
| 611 | AL136566 | | | 1451287_s_at | Mouse homologue on Chromosome 2 |
| 612 | NM_005545 | ISLR | immunoglobulin superfamily containing leucine-rich repeat | 1418450_at | |
| 613 | AF327066 | FLI1 | Friend leukemia virus integration 1 | 1422024_at | |
| 614 | U73531 | CXCR6 | chemokine (C—X—C motif) receptor 6 | 1422812_at | |
| 615 | BC016797 | C7orf19 | chromosome 7 open reading frame 19 | 1434762_at | |
| 616 | BE781857 | KIAA0460 | KIAA0460 protein | 1437641_at | |
| 617 | NM_024660 | FLJ22573 | hypothetical protein FLJ22573 | 1441880_x_at | |
| 618 | NM_019099 | LOC55924 | hypothetical protein LOC55924 | 1444723_at | |
| 619 | AL133001 | SULF2 | sulfatase 2 | 1447602_x_at | |
| 620 | NM_024587 | FLJ22353 | hypothetical protein FLJ22353 | 1451479_a_at | |
| 621 | AI954412 | FLJ13305 | hypothetical protein FLJ13305 | 1451653_a_at | |
| 622 | AI393309 | MGC45386 | Similar to RIKEN cDNA 1110033O09 gene | 1452875_at | |
| 623 | NM_030581 | WDR59 | WD repeat domain 59 | 1456638_at | |
| 624 | NM_017585 | SLC2A6 | solute carrier family 2 (facilitated glucose transporter), member 6 | 1434015_at | |

The following 7 human genes are exclusively associated with asymmetric self renewal and their murine homologues are located on Chromosome 2: AF308602; AI264121; AU160041; AL136573; NM_017585; AF047004; and AL136566.

The following 13 human genes are exclusively associated with asymmetric self renewal and their murine homologues are NOT located on Chromosome 2: NM_005545; AF327066; U73531; BC016797; BE781857; NM_024660; NM_019099; AL133001; NM_024587; AI954412; AI393309; NM_030581; and NM_017585.

TABLE 7

Overlap between Gene Set 1 (Exclusive Aymmetric Self-Renewal) and Stem Cell Enriched Genes previously described

| Affy ID | 1 | 2 | 3 | 4 | 5 | 6 | 7 | 8 | 9 | Mouse Gene | Mouse gene description |
|---|---|---|---|---|---|---|---|---|---|---|---|
| 1417009_at | | | + | | | | | | | C1r | complement component 1, r subcomponent |

TABLE 7-continued

Overlap between Gene Set 1 (Exclusive Aymmetric Self-Renewal) and Stem Cell Enriched Genes previously described

| Probe ID | 1 | 2 | 3 | 4 | 5 | 6 | Gene | Description |
|---|---|---|---|---|---|---|---|---|
| 1417271_a_at | + |  | + |  |  |  | Eng | Endoglin |
| 1417392_a_at |  | + |  | + |  |  | Slc7a7 | solute carrier family 7 (cationic amino acid transporter, y+ system), member 7 |
| 1417801_a_at |  |  | + |  |  |  | Ppfibp2 | protein tyrosine phosphatase, receptor-type, F interacting protein, binding protein 2 |
| 1418051_at |  |  | + |  |  |  | Ephb6 | Eph receptor B6 |
| 1418393_a_at |  |  |  |  | + |  | Itga7 | integrin alpha 7 |
| 1418633_at | + | + |  | + | + |  | Notch1 | Notch gene homolog 1 (*Drosophila*) |
| 1418912_at |  | + | + | + |  |  | Plxdc2 | plexin domain containing 2 |
| 1419758_at |  | + |  |  |  |  | Abcb1a | ATP-binding cassette, sub-family B (MDR/TAP), member 1A |
| 1421279_at | + | + |  | + |  |  | Lamc2 | laminin, gamma 2 |
| 1421679_a_at |  | + |  |  |  |  | Cdkn1a | cyclin-dependent kinase inhibitor 1A (P21) |
| 1421924_at | + | + |  | + | + |  | Slc2a3 | solute carrier family 2 (facilitated glucose transporter), member 3 |
| 1422534_at |  | + | + |  |  | + | Cyp51 | cytochrome P450, family 51 |
| 1423091_a_at |  | + |  |  |  |  | Gpm6b | glycoprotein m6b |
| 1423845_at |  | + |  |  |  |  | AI481750 | expressed sequence AI481750 |
| 1424478_at |  | + |  |  |  |  | Bbs2 | Bardet-Biedl syndrome 2 homolog (human) |
| 1424595_at | + | + | + |  | + |  | F11r | F11 receptor |
| 1425217_a_at |  |  | + |  |  |  | Synj2 | synaptojanin 2 |
| 1425391_a_at |  |  | + |  |  |  | Osbpl5 | oxysterol binding protein-like 5 |
| 1425743_at |  | + | + | + | + | + | Trim7 | tripartite motif protein 7 |
| 1426443_at |  |  | + |  |  |  | Rhbdl7 | rhomboid, veinlet-like 7 (*Drosophila*) |
| 1427142_s_at |  | + | + |  |  |  | Jarid1b | jumonji, AT rich interactive domain 1B (Rbp2 like) |
| 1427739_a_at | + | + | + | + | + | + | Trp53 | transformation related protein 53 |
| 1428705_at |  | + | + |  |  |  | 1700007K13Rik | RIKEN cDNA 1700007K13 gene |
| 1428891_at |  |  | + |  |  |  | 9130213B05Rik | RIKEN cDNA 9130213B05 gene |
| 1429098_s_at |  | + |  |  |  |  | 1700029B21Rik | RIKEN cDNA 1700029B21 gene |
| 1432826_a_at |  | + |  |  |  |  | Cd80 | CD80 antigen |
| 1434645_at |  |  | + |  |  |  | C530008M17Rik | RIKEN cDNA C530008M17 gene |
| 1434793_at |  | + |  |  |  |  | BC028975 | cDNA sequence BC028975 |
| 1434877_at | + |  | + |  |  |  | Nptx1 | neuronal pentraxin 1 |
| 1434917_at |  |  | + |  |  |  | Cobl | cordon-bleu |
| 1437012_x_at |  | + | + |  |  |  | Rapgef3 | Rap guanine nucleotide exchange factor (GEF) 3 |
| 1437613_s_at |  | + | + |  |  |  | AW456874 | expressed sequence AW456874 |
| 1448989_a_at |  | + | + |  | + | + | Myo1b | myosin IB |
| 1450243_a_at |  | + | + |  |  |  | Dscr1l1 | Down syndrome critical region gene 1-like 1 |
| 1450929_at |  |  |  |  | + |  | Zfp57 | zinc finger protein 57 |
| 1451019_at | + | + | + |  |  |  | Ctsf | cathepsin F |
| 1451287_s_at |  |  | + |  |  |  | 2810003C17Rik | RIKEN cDNA 2810003C17 gene |
| 1452127_a_at |  |  | + | + |  | + | Ptpn13 | protein tyrosine phosphatase, non-receptor type 13 |
| 1452322_a_at |  |  | + |  |  |  | Wdr9 | WD repeat domain 9 |

TABLE 7-continued

Overlap between Gene Set 1 (Exclusive Aymmetric Self-Renewal) and Stem Cell Enriched Genes previously described

| | | | | | | |
|---|---|---|---|---|---|---|
| 1453317_a_at | | + | + | + | Khdrbs3 | KH domain containing, RNA binding, signal transduction associated 3 |
| 1453836_a_at | | | + | | Mgll | monoglyceride lipase |
| 1454830_at | | | + | | Fbn2 | fibrillin 2 |
| 1454931_at | | + | + | + | Cri2 | CREBBP/EP300 inhibitory protein 2 |
| 1418205_at | | | + | | — | — |
| 1428025_s_at | | + | + | | Pitpnc1 | phosphatidylinositol transfer protein, cytoplasmic 1 |
| 1434264_at | | | + | | Ank2 | Ankyrin 2, brain |
| 1435744_at | | + | + | + | 6720401G13Rik | RIKEN cDNA 6720401G13 gene |
| 1436014_a_at | + | | | | Rusc1 | RUN and SH3 domain containing 1 |
| 1439011_at | + | | | | — | Transcribed locus |
| 1455165_at | | | + | + | — | Transcribed locus |
| 1456287_at | | + | | | BB236558 | expressed sequence BB236558 |
| 1417682_a_at | + | | | | Prss2 | protease, serine, 2 |
| 1451224_at | | | + | | Scamp5 | secretory carrier membrane protein 5 |

| Affy ID | GO Biological Process Description | Mouse GenBank ID | Human GenBank ID | Human Gene |
|---|---|---|---|---|
| 1417009_at | proteolysis and peptidolysis /// immune response /// complement activation, classical pathway | NM_023143 | AL573058 | C1R |
| 1417271_a_at | cell adhesion /// circulation /// organogenesis | NM_007932 | NM_000118 | ENG |
| 1417392_a_at | protein complex assembly /// amino acid metabolism /// transport /// transport /// amino acid transport | NM_011405 | NM_003982 | SLC7A7 |
| 1417801_a_at | cell communication | NM_008905 | AK001131 | PPFIBP2 |
| 1418051_at | protein amino acid phosphorylation /// transmembrane receptor protein tyrosine kinase signaling pathway | NM_007680 | NM_004445 | EPHB6 |
| 1418393_a_at | cellular morphogenesis /// homophilic cell adhesion /// cell-matrix adhesion /// integrin-mediated signaling pathway /// muscle development | NM_008398 | AK022548 | ITGA7 |
| 1418633_at | transcription /// regulation of transcription, DNA-dependent /// immune response /// Notch signaling pathway /// cell differentiation /// regulation of development | NM_008714 | AF308602 | NOTCH1 |
| 1418912_at | development | BB559706 | AI264121 | PLXDC2 |
| 1419758_at | transport /// response to drug /// lipid metabolism /// transport /// transport /// response to xenobiotic stimulus /// response to drug | M30697 | AF016535 | ABCB1 /// ABCB4 |
| 1421279_at | cell adhesion /// epidermis development | NM_008485 | NM_018891 | LAMC2 |
| 1421679_a_at | regulation of cyclin dependent protein kinase activity /// cell cycle arrest /// cell cycle arrest /// negative regulation of cell proliferation /// induction of apoptosis by intracellular signals | NM_007669 | NM_000389 | CDKN1A |
| 1421924_at | carbohydrate metabolism /// carbohydrate transport /// glucose transport | M75135 | AA718684 | SLC2A3 /// SLC2A14 |
| 1422534_at | electron transport /// cholesterol biosynthesis /// transport | NM_020010 | NM_000786 | CYP51A1 |

TABLE 7-continued

Overlap between Gene Set 1 (Exclusive Aymmetric Self-Renewal) and Stem Cell Enriched Genes previously described

| | | | | |
|---|---|---|---|---|
| 1423091_a_at | neurogenesis /// cell differentiation | AK016567 | AF016004 | GPM6B |
| 1423845_at | regulation of transcription, DNA-dependent /// mRNA processing /// histone mRNA 3'-end processing | BC016109 | AL023553 | PIPPIN |
| 1424478_at | cell-matrix adhesion /// sensory perception /// visual perception | AF342737 | AF342736 | BBS2 |
| 1424595_at | cell motility /// inflammatory response | BC021876 | AF191495 | F11R |
| 1425217_a_at | RNA binding /// phosphoinositide 5-phosphatase activity /// hydrolase activity | AF041862 | AF318616 | SYNJ2 |
| 1425391_a_at | lipid transport /// Golgi to plasma membrane transport /// steroid metabolism /// cholesterol metabolism /// cholesterol transport | AB074008 | AL136918 | OSBPL5 |
| 1425743_at | protein ubiquitination | AF396656 | AF220032 | TRIM7 |
| 1426443_at | — | BB233055 | AF226732 | RHBDL7 |
| 1427142_s_at | regulation of transcription, DNA-dependent | BC019446 | AF087481 | JARID1B |
| 1427739_a_at | cell cycle checkpoint /// base-excision repair /// nucleotide-excision repair /// DNA recombination /// transcription /// regulation of transcription, DNA-dependent /// apoptosis /// cell cycle arrest /// cell aging /// cell proliferation /// induction of | AJ297973 | K03199 | TP53 |
| 1428705_at | — | AK005731 | AU160041 | C9orf116 |
| 1428891_at | — | AK008716 | AI659927 | DKFZP564O0823 |
| 1429098_s_at | electron transport | AK006481 | NM_024782 | FLJ12610 |
| 1432826_a_at | immune response /// intracellular signaling cascade /// cell-cell signaling /// positive regulation of signal transduction /// T-cell activation /// positive regulation of interleukin-2 biosynthesis /// positive regulation of granulocyte macrophage colony | AK019867 | NM_005191 | CD80 |
| 1434645_at | — | BB493717 | BE855799 | KIAA1211 |
| 1434793_at | — | AI851014 | NM_024763 | FLJ23129 |
| 1434877_at | transport /// synaptic transmission /// central nervous system development | AI152800 | NM_002522 | NPTX1 |
| 1434917_at | — | BQ173923 | NM_015198 | COBL |
| 1437012_x_at | protein amino acid phosphorylation /// small GTPase mediated signal transduction /// cell proliferation | BB226235 | U78168 | RAPGEF3 |
| 1437613_s_at | protein amino acid dephosphorylation | BB275142 | BE046919 | PTPDC1 |
| 1448989_a_at | — | AI255256 | BF215996 | MYO1B |
| 1450243_a_at | central nervous system development /// calcium-mediated signaling | NM_030598 | NM_005822 | DSCR1L1 |
| 1450929_at | regulation of transcription, DNA-dependent | BB549686 | AW440310 | Zfp57 |
| 1451019_at | proteolysis and peptidolysis | AK017474 | NM_003793 | CTSF |
| 1451287_s_at | phosphoprotein phosphatase activity /// calcium ion binding | BC024599 | AL136566 | C9orf58 |
| 1452127_a_at | protein amino acid dephosphorylation | BM236743 | NM_006264 | PTPN13 |
| 1452322_a_at | cell cycle | BM230348 | AW268572 | WDR9 |
| 1453317_a_at | spermatogenesis | AK014353 | AF069681 | KHDRBS3 |
| 1453836_a_at | lipid metabolism /// aromatic compound metabolism /// inflammatory response | AK006949 | BC006230 | MGLL |
| 1454830_at | morphogenesis | AV010392 | NM_001999 | FBN2 |
| 1454931_at | proteolysis and peptidolysis | BE225694 | BE747815 | CRI2 |
| 1418205_at | | | N/A | N/A |
| 1428025_s_at | | | N/A | N/A |
| 1434264_at | | | N/A | N/A |
| 1435744_at | | | N/A | N/A |
| 1436014_a_at | | | N/A | N/A |
| 1439011_at | | | N/A | N/A |

TABLE 7-continued

Overlap between Gene Set 1 (Exclusive Aymmetric Self-Renewal) and Stem Cell Enriched Genes previously described

| | | |
|---|---|---|
| 1455165_at | N/A | N/A |
| 1456287_at | N/A | N/A |
| 1417682_a_at | N/A | N/A |
| 1451224_at | N/A | N/A |

Key
1: Melton ES cells
2: Melton NS cells
3.: Melton HS cells
4: Lemischka ES cells
5: Lemischka NS cells
6: Lemischka HS cells
7: Fortunel ES cells
8: Forunel NS cells
9: Fortunel RP cells

TABLE 8

Members of gene Set 1 (Exclusive Aymmetric Self-Renewal) which were not previously described as stem cell enriched genes

| Affy ID | Mouse gene title | Mouse gene symbol | Mouse GenBank ID | Human GenBank ID | Human Gene | GO Biological Process Description |
|---|---|---|---|---|---|---|
| 1416645_a_at | alpha fetoprotein | Afp | NM_007423 | NM_001134 | AFP | transport /// immune response |
| 1417310_at | transducer of ERBB2, 2 | Tob2 | AV174616 | AB051450 | TOB2 | regulation of cell cycle /// female gamete generation /// negative regulation of cell proliferation |
| 1418450_at | immunoglobulin superfamily containing leucine-rich repeat | Islr | NM_012043 | NM_005545 | ISLR | cell adhesion |
| 1418519_at | aminoadipate aminotransferase | Aadat | BC012637 | AF097994 | AADAT | biosynthesis |
| 1418626_a_at | clusterin | Clu | NM_013492 | M25915 | CLU | lipid metabolism /// apoptosis /// immune response /// complement activation, classical pathway /// fertilization (sensu Metazoa) /// cell death |
| 1418632_at | ubiquitin-conjugating enzyme E2H | Ube2h | BI694835 | Z29331 | UBE2H | ubiquitin cycle |
| 1419238_at | ATP-binding cassette, sub-family A (ABC1), member 7 | Abca7 | NM_013850 | NM_019112 | ABCA7 | transport |
| 1419389_at | phosphodiesterase 10A | Pde10a | BQ180352 | AB026816 | PDE10A | signal transduction |
| 1419671_a_at | interleukin 17 receptor C | Il17rc | NM_134159 | BC006411 | IL17RC | receptor activity |
| 1420578_at | opticin | Optc | NM_054076 | AF161702 | OPTC | extracellular matrix structural constituent |
| 1421987_at | 3'-phosphoadenosine 5'-phosphosulfate synthase 2 | Papss2 | BF786072 | AW299958 | PAPSS2 | sulfate assimilation /// skeletal development /// nucleobase, nucleoside, nucleotide and nucleic acid metabolism |
| 1422024_at | Friend leukemia integration 1 | Fli1 | NM_008026 | AF327066 | FLI1 | transcription /// regulation of transcription, DNA-dependent /// hemostasis /// organogenesis |
| 1422253_at | procollagen, type X, alpha 1 | Col10a1 | NM_009925 | AI376003 | COL10A1 | skeletal development /// phosphate transport |
| 1422647_at | ring finger protein 1 | Ring1 | NM_009066 | NM_002931 | RING1 | transcription /// regulation of transcription, DNA-dependent /// protein ubiquitination /// chromatin modification |
| 1422812_at | chemokine (C—X—C motif) receptor 6 | Cxcr6 | NM_030712 | U73531 | CXCR6 | signal transduction /// G-protein coupled receptor protein signaling pathway /// viral genome replication |
| 1422977_at | glycoprotein Ib, beta polypeptide | Gp1bb | NM_010327 | AI860917 | GP1BB | cell adhesion /// cell surface receptor linked signal transduction /// platelet activation |
| 1423285_at | coagulation factor C homolog (*Limulus polyphemus*) | Coch | BB731671 | BC007230 | COCH | perception of sound |
| 1425170_a_at | a disintegrin and metalloproteinase domain 15 (metargidin) | Adam15 | BC009132 | AK000667 | ADAM15 | proteolysis and peptidolysis /// cell-matrix adhesion |

TABLE 8-continued

Members of gene Set 1 (Exclusive Aymmetric Self-Renewal) which were not previously described as stem cell enriched genes

| Affy ID | Mouse gene title | Mouse gene symbol | Mouse GenBank ID | Human GenBank ID | Human Gene | GO Biological Process Description |
|---|---|---|---|---|---|---|
| 1425816_at | zinc finger protein 287 | Zfp287 | AF281141 | AL359578 | ZNF287 | transcription /// regulation of transcription, DNA-dependent |
| 1425868_at | Similar to Histone H2B 291B | — | BC019122 | NM_003524 | HIST1H2BH | nucleosome assembly /// nucleosome assembly /// chromosome organization and biogenesis (sensu Eukaryota) |
| 1426082_a_at | solute carrier family 16 (monocarboxylic acid transporters), member 4 | Slc16a4 | BC025441 | NM_004696 | SLC16A4 | transport /// monocarboxylic acid transport |
| 1426225_at | retinol binding protein 4, plasma | Rbp4 | U63146 | NM_006744 | RBP4 /// KIAA1922 | transport /// sensory perception /// visual perception |
| 1426563_at | zinc finger protein 553 | Zfp553 | BB770954 | AI870369 | ZNF553 | nucleic acid binding /// zinc ion binding |
| 1426926_at | phospholipase C, gamma 2 | Plcg2 | AW546508 | NM_002661 | PLCG2 | lipid metabolism /// phospholipid metabolism /// cell surface receptor linked signal transduction /// intracellular signaling cascade /// lipid catabolism |
| 1427015_at | similar to KIAA1602 protein | LOC380969 | BI732921 | AI784016 | KIAA1602 | — |
| 1427485_at | leiomodin 1 (smooth muscle) | Lmod1 | AF237627 | BC001755 | LMOD1 | tropomyosin binding |
| 1429546_at | endothelial cell growth factor 1 (platelet-derived) | Ecgf1 | BB525750 | NM_001953 | ECGF1 | mitochondrial genome maintenance /// angiogenesis /// pyrimidine base metabolism /// pyrimidine nucleotide metabolism /// DNA replication /// chemotaxis /// cell surface receptor linked signal transduction /// cell-cell signaling /// sensory perception // |
| 1433553_at | GTPase activating RANGAP domain-like 3 | Garnl3 | BB131106 | AL136573 | GARNL3 | small GTPase regulator activity |
| 1434015_at | solute carrier family 2 (facilitated glucose transporter), member 6 | Slc2a6 | BB196807 | NM_017585 | SLC2A6 | carbohydrate transport |
| 1434762_at | RIKEN cDNA A730041O15 gene | A730041O15Rik | BF457736 | BC016797 | C7orf19 | — |
| 1435708_at | Glutaminase | Gls | BB355415 | NM_014905 | GLS | glutamine catabolism |
| 1437641_at | RIKEN cDNA 4930535B03 gene | 4930535B03Rik | BE981473 | BE781857 | KIAA0460 | — |
| 1437820_at | forkhead-like 18 (Drosophila) | Fkhl18 | BB040642 | AL160175 | FKHL18 | transcription /// regulation of transcription, DNA-dependent /// development |
| 1438431_at | ATP-binding cassette, sub-family D (ALD), member 2 | Abcd2 | BB197269 | NM_005164 | ABCD2 | fatty acid metabolism /// transport |
| 1438946_at | platelet derived growth factor receptor, alpha polypeptide | Pdgfra | BB221015 | M22734 | PDGFRA | protein amino acid phosphorylation /// cell surface receptor linked signal transduction /// transmembrane receptor protein tyrosine kinase signaling pathway /// cell proliferation |
| 1440844_at | Transducer of ErbB-2.1 | Tob1 | AA242096 | BF240286 | TOB1 | negative regulation of cell proliferation |
| 1441880_x_at | hypothetical protein MGC30332 | MGC30332 | BB009770 | NM_024660 | FLJ22573 | — |
| 1441906_x_at | Synapse associated protein 1 | Syap1 | BB365629 | BG029566 | SYAP1 | — |
| 1443227_at | Basic leucine zipper and W2 domains 2 | Bzw2 | BB437937 | NM_014038 | BZW2 | regulation of translational initiation |
| 1443687_x_at | Histocompatibility 2, class II, locus Mb1 | H2-DMb1 | BB734586 | NM_002118 | HLA-DMB | immune response /// detection of pest, pathogen or parasite /// antigen presentation, exogenous antigen /// antigen processing, exogenous antigen via MHC class II |
| 1443689_at | Ubiquitin specific protease 32 | Usp32 | BB740339 | AI148567 | USP32 | ubiquitin-dependent protein catabolism /// ubiquitin cycle |
| 1444723_at | RIKEN cDNA 6530418L21 gene | 6530418L21Rik | BB049759 | NM_019099 | LOC55924 | — |
| 1447364_x_at | myosin IB | Myo1b | AA406997 | BF432550 | MYO1B | motor activity /// actin binding /// calmodulin binding /// ATP binding |
| 1447602_x_at | sulfatase 2 | Sulf2 | AU020235 | AL133001 | SULF2 | amino acid metabolism /// metabolism /// heparan sulfate proteoglycan metabolism |

TABLE 8-continued

Members of gene Set 1 (Exclusive Aymmetric Self-Renewal) which were not previously described as stem cell enriched genes

| Affy ID | Mouse gene title | Mouse gene symbol | Mouse GenBank ID | Human GenBank ID | Human Gene | GO Biological Process Description |
|---|---|---|---|---|---|---|
| 1448001_x_at | cell division cycle associated 3 | Cdca3 | AV352659 | NM_031299 | CDCA3 | — |
| 1448426_at | Sarcosine dehydrogenase | Sardh | BI217574 | AF047004 | SARDH | electron transport /// glycine catabolism |
| 1449630_s_at | MAP/microtubule affinity-regulating kinase 1 | Mark1 | AW491150 | NM_018650 | MARK1 | protein amino acid phosphorylation /// protein amino acid phosphorylation /// cytoskeleton organization and biogenesis /// protein kinase cascade |
| 1451479_a_at | RIKEN cDNA 1110038M16 gene | 1110038M16Rik | BC019937 | NM_024587 | FLJ22353 | — |
| 1451653_a_at | RIKEN cDNA 4930430E16 gene | 4930430E16Rik | BC026495 | AI954412 | FLJ13305 | — |
| 1452875_at | RIKEN cDNA 1110033O09 gene | 1110033O09Rik | AW259452 | AI393309 | MGC45386 | — |
| 1453959_at | RIKEN cDNA 1700065O13 gene | 1700065O13Rik | AK006897 | NM_016264 | ZNF44 | transcription /// regulation of transcription, DNA-dependent |
| 1456346_at | Dynamin 1 | Dnm1 | BB003660 | L07810 | DNM1 | endocytosis /// receptor mediated endocytosis /// synaptic transmission |
| 1456638_at | WD repeat domain 59 | Wdr59 | BB215355 | NM_030581 | WDR59 | receptor activity /// structural molecule activity |
| 1458499_at | phosphodiesterase 10A | Pde10a | AW123977 | AF127480 | PDE10A | signal transduction |
| 1419435_at | aldehyde oxidase 1 | Aox1 | | N/A | N/A | N/A |
| 1426568_at | solute carrier family 2 (facilitated glucose transporter), member 9 | Slc2a9 | | N/A | N/A | N/A |
| 1421668_x_at | spermatogenesis associated glutamate (E)-rich protein 3 | Speer3 | | N/A | N/A | N/A |
| 1422994_at | — | | | N/A | N/A | N/A |
| 1429899_at | RIKEN cDNA 5730414N17 gene | 5730414N17Rik | | N/A | N/A | N/A |
| 1430097_at | RIKEN cDNA 8430436C05 gene | 8430436C05Rik | | N/A | N/A | N/A |
| 1430766_at | RIKEN cDNA 5033403F01 gene | 5033403F01Rik | | N/A | N/A | N/A |
| 1432112_at | RIKEN cDNA 4930589L23 gene | 4930589L23Rik | | N/A | N/A | N/A |
| 1432438_at | RIKEN cDNA 4930597L12 gene | 4930597L12Rik | | N/A | N/A | N/A |
| 1433358_at | RIKEN cDNA A230102O21 gene | A230102O21Rik | | N/A | N/A | N/A |
| 1434277_a_at | hypothetical protein 6430570G24 | 6430570G24 | | N/A | N/A | N/A |
| 1434327_at | — | — | | N/A | N/A | N/A |
| 1436978_at | — | — | | N/A | N/A | N/A |
| 1437366_at | expressed sequence AI608492 | AI608492 | | N/A | N/A | N/A |
| 1437451_at | RIKEN cDNA 1110006O17 gene | 1110006O17Rik | | N/A | N/A | N/A |
| 1439194_at | RIKEN cDNA C030048H21 gene | C030048H21Rik | | N/A | N/A | N/A |
| 1444418_at | Transcribed locus | — | | N/A | N/A | N/A |
| 1446155_at | RIKEN cDNA 2700089E24 gene | 2700089E24Rik | | N/A | N/A | N/A |
| 1448034_at | expressed sequence AI842396 | AI842396 | | N/A | N/A | N/A |
| 1452863_at | RIKEN cDNA 1700003F12 gene | 1700003F12Rik | | N/A | N/A | N/A |
| 1455396_at | Transcribed locus | — | | N/A | N/A | N/A |
| 1455970_at | Transcribed locus | — | | N/A | N/A | N/A |
| 1457415_a_at | RIKEN cDNA 4930513N10 gene | 4930513N10Rik | | N/A | N/A | N/A |
| 1457459_at | expressed sequence AU014973 | AU014973 | | N/A | N/A | N/A |

N/A: No human orthologue target in AffyChip

Sequences Table 9

In Tables 1-8 of the Application, the Applicants have given sequence identifier numbers (SEQ ID NO's) according to Genbank accession numbers and cross referenced these numbers with Affymetrix ID numbers. For example, in Table 6, SEQ ID NO: 605 corresponds to Genebank accession number AF308602, which is the Homo sapiens NOTCH 1 (N1) mRNA, complete coding sequence. SEQ ID NO: 605 also corresponds to the Affymetrix ID number of 1418633_at.

```
SEQ ID NO: 605 AF308602 Homo sapiens NOTCH 1 (N1) mRNA
                                                          (SEQ ID NO: 605)
   1 atgccgccgc tcctggcgcc cctgctctgc ctggcgctgc tgcccgcgct cgccgcacga
  61 ggcccgcgat gctcccagcc cggtgagacc tgcctgaatg gcgggaagtg tgaagcggcc
 121 aatggcacgg aggcctgcgt ctgtggcggg gccttcgtgg gcccgcgatg ccaggacccc
 181 aacccgtgcc tcagcacccc ctgcaagaac gccgggacat gccacgtggt ggaccgcaga
 241 ggcgtggcag actatgcctg cagctgtgcc ctgggcttct ctgggcccct ctgcctgaca
 301 cccctggaca cgcctgcct caccaacccc tgccgcaacg ggggcacctg cgacctgctc
 361 acgctgacgg agtacaagtg ccgctgcccg cccggctggt cagggaaatc gtgccagcag
 421 gctgacccgt gcgcctccaa cccctgcgcc aacggtggcc agtgcctgcc cttcgaggcc
 481 tcctacatct gccactgccc acccagette catggcccca cctgccggca ggatgtcaac
 541 gagtgtggcc agaagcccag gctttgccgc acggaggca cctgccacaa cgaggtcggc
 601 tcctaccgct gcgtctgccg cgccacccac actggcccca actgcgagcg cccctacgtg
 661 ccctgcagcc cctcgccctg ccagaacggg ggcacctgcc gccccacggg cgacgtcacc
 721 cacgagtgtg cctgcctgcc aggcttcacc ggccagaact gtgaggaaaa tatcgacgat
 781 tgtccaggaa acaactgcaa gaacgggggt gcctgtgtgg acggcgtgaa cacctacaac
 841 tgcccgtgcc cgccagagtg gacaggtcag tactgtaccg aggatgtgga cgagtgccag
 901 ctgatgccaa atgcctgcca gaacggcggg acctgccaca cacccacgg tggctacaac
 961 tgcgtgtgtg tcaacggctg gactggtgag gactgcagcg agaacattga tgactgtgcc
1021 agcgccgcct gcttccacgg cgccacctgc catgaccgtg tggcctcctt ttactgcgag
1081 tgtccccatg gccgcacagg tctgctgtgc cacctcaacg acgcatgcat cagcaacccc
1141 tgtaacgagg gctccaactg cgacaccaac cctgtcaatg gcaaggccat ctgcacctgc
1201 ccctcggggt acacgggccc ggcctgcagc caggacgtgg atgagtgctc gctgggtgcc
1261 aaccctgcg agcatgcggg caagtgcatc aacacgctgg gctccttcga gtgccagtgt
1321 ctgcagggct acacgggccc ccgatgcgag atcgacgtca acgagtgcgt ctcgaacccg
1381 tgccagaacg acgccacctg cctggaccag attggggagt tccagtgcat gtgcatgccc
1441 ggctacgagg gtgtgcactg cgaggtcaac acagacgagt gtgccagcag ccctgcctg
1501 cacaatggcc gctgcctgga caagatcaat gagttccagt gcgagtgccc cacgggcttc
1561 actgggcatc tgtgccagta cgatgtggac gagtgtgcca gcaccccctg caagaatggt
1621 gccaagtgcc tggacggacc caacacttac acctgtgtgt gcacggaagg gtacacgggg
1681 acgcactgcg aggtggacat cgatgagtgc gacccegace cctgccacta cggctcctgc
1741 aaggacggcg tcgccacctt cacctgcctc tgccgcccag gctacacggg ccaccactgc
1801 gagaccaaca tcaacgagtg ctccagccag ccctgccgcc tacggggcac ctgccaggac
1861 ccggacaacg cctacctctg cttctgcctg aaggggacca caggacccaa ctgcgagatc
1921 aacctggatg actgtgccag cagcccctgc gactcgggca cctgtctgga caagatcgat
1981 ggctacgagt gtgcctgtga gccgggctac acagggagca tgtgtaacag caacatcgat
2041 gagtgtgcgg gcaacccctg ccacaacggg ggcacctgcg aggacggcat caatggcttc
```

```
                                -continued
2101 acctgccgct gccccgaggg ctaccacgac cccacctgcc tgtctgaggt caatgagtgc 2161 aacagcaacc cctgcgtcca cggggcctgc cgggacagcc tcaacgggta caagtgcgac 2221 tgtgaccctg ggtggagtgg gaccaactgt gacatcaaca acaacgagtg tgaatccaac 2281 ccttgtgtca acggcggcac ctgcaaagac atgaccagtg gcatcgtgtg cacctgccgg 2341 gagggcttca gcggtcccaa ctgccagacc aacatcaacg agtgtgcgtc caacccatgt 2401 ctgaacaagg gcacgtgtat tgacgacgtt gccgggtaca agtgcaactg cctgctgccc 2461 tacacaggtg ccacgtgtga ggtggtgctg gccccgtgtg cccccagccc ctgcagaaac 2521 ggcggggagt gcaggcaatc cgaggactat gagagcttct cctgtgtctg ccccacggct 2581 ggggccaaag ggcagacctg tgaggtcgac atcaacgagt gcgttctgag cccgtgccgg 2641 cacggcgcat cctgccagaa cacccacggc gsstaccgct gccactgcca ggccggctac 2701 agtgggcgca actgcgagac cgacatcgac gactgccggc ccaacccgtg tcacaacggg 2761 ggctcctgca cagacggcat caacacggcc ttctgcgact gcctgccggg cttccggggc 2821 actttctgtg aggaggacat caacgagtgt gccagtgacc cctgccgcaa cggggccaac 2881 tgcacggact gcgtggacag ctacacgtgc acctgccccg caggcttcag cgggatccac 2941 tgtgagaaca acacgcctga ctgcacagag agctcctgct tcaacggtgg cacctgcgtg 3001 gacggcatca actcgttcac ctgcctgtgt ccacccggct tcacgggcag ctactgccag 3061 cacgtagtca atgagtgcga ctcacgaccc tgcctgctag gcggcacctg tcaggacggt 3121 cgcggtctcc acaggtgcac ctgccccccag ggctacactg gccccaactg ccagaaccct 3181 gtgcactggt gtgactcctc gccctgcaag aacggcggca aatgctggca gacccacacc 3241 cagtaccgct gcgagtgccc cagcggctgg accggcctttt actgcgacgt gccccagcgtg 3301 tcctgtgagg tggctgcgca gcgacaaggt gttgacgttg cccgcctgtg ccagcatgga 3361 gggctctgtg tggacgcggg caacacgcac cactgccgct gccaggcggg ctacacaggc 3421 agctactgtg aggacctggt ggacgagtgc tcacccagcc cctgccagaa cggggccacc 3481 tgcacggact acctgggcgg ctactcctgc aagtgcgtgg ccggctacca cggggtgaac 3541 tgctctgagg agatcgacga gtgcctctcc caccccctgcc agaacggggg cacctgcctc 3601 gacctcccca cacctacaa gtgctcctgc ccacggggca ctcagggtgt gcactgtgag 3661 atcaacgtgg acgactgcaa tccccccgtt gaccccgtgt cccggagccc caagtgcttt 3721 aacaacggca cctgcgtgga ccaggtgggc ggctacagct gcacctgccc gccgggcttc 3781 gtgggtgagc gctgtgaggg ggatgtcaac gagtgcctgt ccaatccctg cgacgcccgt 3841 ggcacccaga actgcgtgca gcgcgtcaat gacttccact gcgagtgccg tgctggtcac 3901 accgggcgcc gctgcgagtc cgtcatcaat ggctgcaaag gcaagccctg caagaatggg 3961 ggcacctgcg ccgtggcctc caacaccgcc cgcgggttca tctgcaagtg ccctgcgggc 4021 ttcgagggcg ccacgtgtga gaatgacgct cgtacctgcg gcagcctgcg ctgcctcaac 4081 ggcggcacat gcatctccgg cccgcgcagc cccacctgcc tgtgcctggg ccccttcacg 4141 ggccccgaat gccagttccc ggccagcagc ccctgcctgg gcggcaaccc ctgctacaac 4201 caggggacct gtgagcccac atccgagagc cccttctacc gttgcctgtg ccccgccaaa 4261 ttcaacgggc tcttgtgcca catcctggac tacagcttcg ggggtggggc cgggcgcgac 4321 atccccccgc cgctgatcga ggaggcgtgc gagctgcccg agtgccagga ggacgcgggc 4381 aacaaggtct gcagcctgca gtgcaacaac cacgcgtgcg gctgggacgg cggtgactgc 4441 tccctcaact tcaatgaccc ctggaagaac tgcacgcagt ctctgcagtg ctggaagtac
```

-continued

```
4501 ttcagtgacg gccactgtga cagccagtgc aactcagccg gctgcctctt cgacggcttt
4561 gactgccagc gtgcggaagg ccagtgcaac cccctgtacg accagtactg caaggaccac
4621 ttcagcgacg ggcactgcga ccagggctgc aacagcgcgg agtgcgagtg ggacgggctg
4681 gactgtgcgg agcatgtacc cgagaggctg gcggccggca cgctggtggt ggtggtgctg
4741 atgccgccgg agcagctgcg caacagctcc ttccacttcc tgcgggagct cagccgcgtg
4801 ctgcacacca acgtggtctt caagcgtgac gcacacggcc agcagatgat cttcccctac
4861 tacggccgcg aggaggagct gcgcaagcac cccatcaagc gtgccgccga gggctgggcc
4921 gcacctgacg ccctgctggg ccaggtgaag gcctcgctgc tccctggtgg cagcgagggt
4981 gggcggcggc ggagggagct ggaccccatg gacgtccgcg gctccatcgt ctacctggag
5041 attgacaacc ggcagtgtgt gcaggcctcc tcgcagtgct tccagagtgc caccgacgtg
5101 gccgcattcc tgggagcgct cgcctcgctg ggcagcctca acatccccta caagatcgag
5161 gccgtgcaga gtgagaccgt ggagccgccc ccgccggcgc agctgcactt catgtacgtg
5221 gcggcggccg cctttgtgct tctgttcttc gtgggctgcg gggtgctgct gtcccgcaag
5281 cgccggcggc agcatggcca gctctggttc cctgagggct tcaaagtgtc tgaggccagc
5341 aagaagaagc ggcgggagcc cctcggcgag gactccgtgg gcctcaagcc cctgaagaac
5401 gcttcagacg gtgccctcat ggacgacaac cagaatgagt gggggacga ggacctggag
5461 accaagaagt tccggttcga ggagcccgtg gttctgcctg acctgacga ccagacagac
5521 caccggcagt ggactcagca gcacctggat gccgctgacc tgcgcatgtc tgccatggcc
5581 cccacaccgc cccagggtga ggttgacgcc gactgcatgg acgtcaatgt ccgcgggcct
5641 gatggcttca ccccgctcat gatcgcctcc tgcagcgggg cggcctggga cgggcaac
5701 agcgaggaag aggaggacgc gccggccgtc atctccgact tcatctacca gggcgccagc
5761 ctgcacaacc agacagaccg cacgggcgag accgccttgc acctggccgc cgctactca
5821 cgctctgatg ccgccaagcg cctgctggag gccagcgcag atgccaacat ccaggacaac
5881 atgggccgca ccccgctgca tgcggctgtg tctgccgacg cacaaggtgt cttccagatc
5941 ctgatccgga accgagccac agacctggat gcccgcatgc atgatggcac gacgccactg
6001 atcctggctg cccgcctggc cgtggagggc atgctggagg acctcatcaa ctcacacgcc
6061 gacgtcaacg ccgtagatga cctgggcaag tccgccctgc actgggccgc cgccgtgaac
6121 aatgtggatg ccgcagttgt gctcctgaag aacgggcta acaaagatat gcagaacaac
6181 agggaggaga caccctgtt tctggccgcc cgggagggca gctacgagac cgccaaggtg
6241 ctgctggacc actttgccaa ccgggacatc acggatcata tggaccgcct gccgcgcgac
6301 atcgcacagg agcgcatgca tcacgacatc gtgaggctgc tggacgagta caacctggtg
6361 cgcagcccgc agctgcacgg agccccgctg gggggcacgc ccaccctgtc gccccgctc
6421 tgctcgccca acggctacct gggcagcctc aagcccggcg tgcagggcaa gaaggtccgc
6481 aagcccagca gcaaaggcct ggcctgtgga agcaaggagg ccaaggacct caaggcacgg
6541 aggaagaagt cccaggatgg caagggctgc ctgctggaca gctccggcat gctctcgccc
6601 gtggactccc tggagtcacc ccatggctac ctgtcagacg tggcctcgcc gccactgctg
6661 ccctccccgt tccagcagtc tccgtccgtg cccctcaacc acctgcctgg gatgcccgac
6721 acccacctgg gcatcgggca cctgaacgtg gcggccaagc ccgagatggc ggcgctgggt
6781 ggggcggcc ggctggcctt tgagactggc ccacctcgtc tctcccacct gcctgtggcc
6841 tctggcacca gcaccgtcct gggctccagc agcggagggg ccctgaattt cactgtgggc
```

-continued

```
6901 gggtccacca gtttgaatgg tcaatgcgag tggctgtccc ggctgcagag cggcatggtg 6961 ccgaaccaat acaaccctct gcggggagt gtggcaccag gccccctgag cacacaggcc 7021 ccctccctgc agcatggcat ggtaggcccg ctgcacagta gccttgctgc agcgccctg 7081 tcccagatga tgagctacca gggcctgccc agcacccggc tggccaccca gcctcacctg 7141 gtgcagaccc agcaggtgca gccacaaaac ttacagatgc agcagcagaa cctgcagcca 7201 gcaaacatcc agcagcagca aagcctgcag ccgccaccac caccaccaca gccgcacctt 7261 ggcgtgagct cagcagccag cggccacctg gccggagct tcctgagtgg agagccgagc 7321 caggcagacg tgcagccact gggccccagc agcctggcgg tgcacactat tctgccccag 7381 gagagccccg ccctgcccac gtcgctgcca tcctcgctgg tcccacccgt gaccgcagcc 7441 cagttcctga cgccccctc gcagcacagc tactcctgc ctgtggacaa caccccacc 7501 caccagctac aggtgcctga gcacccttc ctgacccctt cgccggagtc gcccgaccaa 7561 tggtcgtcct cgtcgccgca ctctaatgtg tctgactggt ctgagggcgt gtcgtcgccc 7621 ccgaccctca tgcagtccca gatcgcgcgc atcccggagg cgttcaagta atagctcgag 7681 gtgccagcag ctc
```

SEQ ID NO: 606 A1264121, NCI_CGAP_Kid3 *Homo sapiens* cDNA clone, mRNA sequence (SEQ ID NO: 606)

```
  1 cagcttcttt ttttttttt ttcatgaact aaagctttat tacgattcct ttttttgat 61 ccctttgcac ccctgcacct aagccaaaag cattataatc ttgtcatact tcagataagt 121 ccacgggaga tgttccgagt gaactataga tgacattcca ctagggaatt ctatgttcag 181 tgtaaatggt atcttgtata agttttagtt ttttgtctac cctttgtttc ctgggctgag 241 cttgtccaga aatcttgtct tcttcaggct acagcagctt agagcttgct tgtgtgtgtg 301 tttgtttgtt tgtcttaaag gtataggcaa aattttagtc ttaacacctg taaaccagta 361 ctggtgttgt tctgtcctag aaattttagc actgctctga tacaataaag ccttctttct 421 ctccaactgg ttcaacttca gcataggcag gatgtccaga gcctcttcta aacttcatcg 481 caggccatct gcttgggc
```

SEQ ID NO: 607 AU160041 Y79AA1 *Homo sapiens* cDNA clone Y79AA1000969 3-, mRNA sequence (SEQ ID NO: 607)

```
  1 caggatgtga caacgttttt aatgcaaagt caaccaffag catctttccc atgtacttat 61 tagatgtgaa atggcaggac ttcacggccc cgtttgcata ffttcctact ccgcagacga 121 ataatatttt cagggaaggc agcgcantct gtgccgtcac aatcgggcga ctgtgggtga 181 tgagggatga tgattttcca ggaggccctg gggtcanagg actcctagag ggagtttcca 241 gcccctcaat cgcagatgga tggcctgttg atgttgtaac tggggtggaa gttganccgg 301 tcacaggagg tgatgcagtt atcggggcca gtcacgatgc ttttctccag gtaaacattg 361 agagtattgt tccggaacat ccacccgag gcatctcntg cacggtgggg gctctgctcc 421 cgtaagcctg gttactgggt cctgtcactg aaacagcctt ctgggtcctt gtaaccccg 481 aaccacccng ggttggntna accttgcccg gcanngtccg cgcttacgcc gnaagtna
```

SEQ ID NO: 608 AL136573, *Homo sapiens* mRNA; cDNA DKFZp761J1523 (from clone DKFZp761J1523)

(SEQ ID NO: 608)

```
  1 ataatactga tgaagcattt tgttccagc tctgtctcgg aagacctagg ctgtagacgt 61 ggggatttca gtaggaaaca ttatggatct gtggagctgc ttatttccag tgatgctgat 121 ggagccatcc aaagggctgg aagattcaga gtggaaaatg gctcttcaga tgagaatgca 181 actgccctgc ctggtacttg gcgaagaaca gacgtgcact tagagaaccc agaataccac
```

-continued

```
 241 accagatggt atttcaaata ttttttagga caagtccatc agaactacat tggaaacgat
 301 gccgagaaga gcccttctt cttgtccgtg accctttctg accaaaacaa tcaacgtgtc
 361 cctcaatacc gtgcaattct ttggagaaaa acaggtaccc agaaaatatg ccttccctac
 421 agtcccacaa aaactctttc tgtgaagtcc atcttaagtg ccatgaatct ggacaaattt
 481 gagaaaggcc ccagggaaat ttttcatcct gaaatacaaa aggacttgct ggttcttgaa
 541 gaacaagagg gctctgtgaa tttcaagttt ggggttcttt ttgccaaaga tgggcagctc
 601 actgatgatg agatgttcag caatgaaatt ggaagcgagc cttttcaaaa attttttaaat
 661 cttctgggtg acacaatcac tctaaagggc tggacgggct accgtggcgg tctggatacc
 721 aaaaatgata ccacagggat acattcagtt tatactgtgt accaagggca tgagatcatg
 781 tttcatgttt ccaccatgtt gccatattcc aaagagaaca acagcaggt ggaaaggaaa
 841 cgccacattg gaaacgatat cgtcaccatt gtgttccaag aaggagagga atcttctcct
 901 gcctttaagc cttccatgat ccgctcccac tttacacata ttttttgcctt agtgagatac
 961 aatcaacaaa atgacaatta caggctgaaa atattttcag aagagagcgt accactcttt
1021 ggccctccct tgccaactcc accagtgttt acagaccacc aggaattcag ggactttttg
1081 ctagtgaaat taattaatgg tgaaaaagcc actttggaaa ccccaacatt tgcccagaaa
1141 cgtcggcgta ccctggatat gttgattaga tctttacacc aggatttgat gccagatttg
1201 cataagaaca tgcttaatag acgatctttt agtgatgtct taccagagtc acccaagtca
1261 gcgcggaaga aagaggaggc ccgccaggcg gagtttgtta gaatagggca ggcactaaaa
1321 ctgaaatcca ttgtgagagg ggatgctcca tcaagcttgg cagcttcagg gatctgtaaa
1381 aaagagccgt gggagcccca gtgtttctgc agtaatttcc ctcatgaagc cgtgtgtgca
1441 gatccctggg gccaggcctt gctggtttcc actgatgctg gcgtcttgct agtggatgat
1501 gaccttccat cagtgcccgt gtttgacaga actctgccag tgaagcaaat gcatgtgctt
1561 gagaccctgg accttctggt tctcagagca gacaaaggaa aagatgctcg cctctttgtc
1621 ttcaggctaa gtgctctgca aaagggcctt gaggggaagc aggctgggaa gagcaggtct
1681 gactgcagag aaaacaagtt ggagaaaaca aaaggctgcc acctgtatgc tattaacact
1741 caccacagca gagagctgag gattgtggtt gcaattcgga ataaactgct tctgatcaca
1801 agaaaacaca acaagccaag cggggtcacc agcacctcat tgttatctcc cctgtctgag
1861 tcacctgttg aagaattcca gtacatcagg gagatctgtc tgtctgactc tcccatggtg
1921 atgaccttag tggatgggcc agctgaagag agtgacaatc tcatctgtgt ggcttatcga
1981 caccaatttg atgtggtgaa tgagagcaca ggagaagcct tcaggctgca ccacgtggag
2041 gccaacaggg ttaattttgt tgcagctatt gatgtgtacg aagatggaga agctggtttg
2101 ctgttgtgtt acaactacag ttgcatctat aaaaaggttt gccccttaa tggtggctct
2161 tttttggttc aaccttctgc gtcagatttc cagttctgtt ggaaccaggc tccctatgca
2221 attgtctgtg ctttcccgta tctcctggcc ttcaccaccg actccatgga gatccgcctg
2281 gtggtgaacg ggaacctggt ccacactgca gtcgtgccgc agctgcagct ggtggcctcc
2341 agggtgaaat tcaatcaaaa aatctgtaca agattccact tagaaacctc gtgggcagaa
2401 gcatcgaacg acctctgaag tcacccttag tctccaaggt catcacccca cccactccca
2461 tcagtgtggg ccttgctgcc attccagtca cgcactcctt gtccctgtct cgcatggaga
2521 tcaaagaaat agcaagcagg acccgcaggg aactactggg cctctcggat gaaggtggac
```

-continued

```
2581 ccaagtcaga aggagcgcca aaggccaaat caaaaccccg gaagcggtta gaagaaagcc 2641 aaggaggccc caagccaggg gcagtgaggt catctagcag tgacaggatc ccatcaggct 2701 ccttggaaag tgcttctact tccgaagcca accctgaggg gcactcagcc agctctgacc 2761 aggaccctgt ggcagacaga gagggcagcc cggtctccgg cagcagcccc ttccagctca 2821 cggctttctc cgatgaagac attatagact tgaagtaaca gagttgaatc tcatttgcca 2881 tctttagttt tcttatggag gtttatactc tttaaacagt tctgatgtaa tttctcaaca 2941 aaatgtggct tttagcctgt cagtgatcta ttggaccaaa ccttctgcac actcggccag 3001 ttccctctcc aatgtccggt gccatctttc ctgacctttg tttctttctg ttcaggaacc 3061 atcagtcccc ttgtaataaa ggtggtagat ttcattgagg ttttagattg aaactttgaa 3121 taaatcaaaa atactcattc ttaaaaaaaa aaaaaaaaa
```

SEQ ID NO: 609 NM_017585 *Homo sapiens* solute carrier family 2 (facilitated glucose transporter), member 6 (SLC2A6), mRNA (SEQ ID NO: 609)

```
   1 ctgagcgccc tccgctcgcc ccgagagaga cccggccatg caggagccgc tgctgggagc 61 cgagggcccg gactacgaca ccttccccga gaagccgccc ccgtcgccag gggacagggc 121 gcgggtcggg accctgcaga acaaaagggt gttcctggcc accttcgccg cagtgctcgg 181 caatttcagc tttgggtatg ccctggtcta cacatcccct gtcatcccag ccctggagcg 241 ctccttggat cctgacctgc atctgaccaa atcccaggca tcctggtttg ggtccgtgtt 301 caccctggga gcagcggccg gaggcctgag tgccatgatc ctcaacgacc tcctgggccg 361 gaagctgagc atcatgttct cagctgtgcc gtcggcggcc ggctatgcgc tcatggcggg 421 tgcgcacggc ctctggatgc tgctgctcgg aaggacgctg acgggcttcg ccggggggct 481 cacagctgcc tgcatcccgg tgtacgtgtc tgagattgct ccccaggcg ttcgtggggc 541 tctgggggcc acacccagc tcatggcagt gttcggatcc ctgtccctct acgcccttgg 601 cctcctgctg ccgtgggcgct ggctggctgt ggccggggag gcgcctgtgc tcatcatgat 661 cctgctgctc agcttcatgc ccaactcgcc gcgcttcctg ctctctcggg gcagggacga 721 agaggccctg cgggcgctgg cctggctgcg tgggacggac gtcgatgtcc actgggagtt 781 cgagcagatc caggacaacg tccggagaca gagcagccga gtatcgtggg ctgaggcacg 841 ggccccacac gtgtgccggc ccatcaccgt ggccttgctg atgcgcctcc tgcagcagct 901 gacgggcatc acgccatcc tggtctacct gcagtccatc ttcgacagca ccgctgtcct 961 gctgcccccc aaggacgacg cagccatcgt tggggccgtg cggctcctgt ccgtgctgat 1021 cgccgccctc accatggacc tcgcaggccg caaggtgctc ctcttcgtct cagcggccat 1081 catgtttgct gccaacctga ctctggggct gtacatccac tttggcccca ggcctctgag 1141 ccccaacagc actgcgggcc tggaaagcga gtcctggggg gacttggcgc agcccctggc 1201 agcacccgct ggctacctca ccctggtgcc cctgctggcc accatgctct tcatcatggg 1261 ctacgccgtg ggctggggtc ccatcacctg gctgctcatg tctgaggtcc tgcccctgcg 1321 tgcccgtggc gtggcctcag ggctctgcgt gctggccagc tggctcaccg ccttcgtcct 1381 caccaagtcc ttcctgccag tggtgagcac cttcggcctc caggtgcctt tcttcttctt 1441 cgcggccatc tgcttggtga gcctggtgtt cacaggctgc tgtgtgcccg agaccaaggg 1501 acgtccctg gagcagatcg agtccttctt ccgcatgggg agaaggtcct tcttgcgcta 1561 ggtcaaggtc cccgctggag gggggccaaa ccccagtgg ctgggcctct gtgttggcta 1621 caaacctgca ccctgggacc aagaggcagc agtcatccct gccaccagcc agagcacagg
```

-continued

```
1681 aagagcagtg tgatggggcc tcagcagcgg gtgcccctgg ctcgggacag gtagcactgc 1741 tgtccagcca cagccccagc ccaggcagcc cacagtgctg cacgtagcca tgggccgcag 1801 gagtgcatac aaccctgcat ccagggacac ggccctgctg ggtgacctca ggcctagtcc 1861 ctttcccttg cgtgaaggac acgccccaca aaggctacg ggaggactg agaggacagg 1921 gctggaggca gccaagtaac gtagtcatat catcgcgctc tgatctggtg gcatctggct 1981 gtgcaaggaa gacccggctt tgccctcaca agtcttatgg gcaccacagg gaacatcctg 2041 gacttaaaaa gccagggcag gccgggcaca gtggctcacg cctgtaatcc cagcactttg 2101 ggaggccaaa gcaggtggat tacccaaggc caggagttca agaccagcct ggccaacatg 2161 gtgaaacccc gtctctacta aaaatacaa aaaagctggg tgtggtggca cacccgta 2221 gttccagcta cttgggaggc tgaggcagca ttgcttgaac ccgggaggtg gaggctgcaa 2281 tgagctgaga tcatgccatt gcactccagc ctgggcaacg agagtgaaac tccgtcccca 2341 cccctgcca aaaaaaaaa aaaaaagcc agggcaaagg acctggcgtg gccacttcct 2401 cctgccccag cccaacctct gggaacaggc agctcctatc tgcaaactgt gttcacccctt 2461 ttgtaaaaat aaaggaactg gacccgt
```

SEQ ID NO: 610 AF047004 *Homo sapiens* dimethylglycine dehydrogenase-like protein isoform 1 mRNA, complete cds (SEQ ID NO: 610)
```
   1 cctggagttc cggccaggcc actgcttggg aagcaagaag gtgaaggcac ctctgctggg 61 ccaagcactc ttagggccga ggggcactgc agctgacaag agctccctgt tttgctgagg 121 cctggagccc ccatggcctc actgagccga gccctacgtg tggctgctgc ccaccctcgc 181 cagagcccta cccggggcat ggggccatgc aacctgtcca gcgcagctgg ccccacagcc 241 gagaagagtg tgccatatca gcggaccctg aaggagggac agggcacctc ggtggtggcc 301 caaggcccaa gccggcccct gcccagcacg gccaacgtgg tggtcattgg tggaggcagc 361 ttgggctgcc agaccctgta ccacctggcc aagctgggca tgagtggggc ggtgctgctg 421 gagcgggagc ggctgacctc cggaccacc tggcacacgg caggcctgct gtggcagctg 481 cggcccagtg acgtggaggt ggagcttctg gcccacactc ggcgggtggt gagccgggag 541 ctggaggagg agacgggact acacacgggc tggatccaga atgggggcct cttcatcgcg 601 tccaaccggc agcgcctgga cgagtacaag aggctcatgt cgctgggcaa ggcgtatggt 661 gtggaatccc atgtgctgag cccggcagag accaagactc tgtacccgct gatgaatgtg 721 gacgacctct acgggaccct gtatgtgccg cacgacggta ccatggaccc cgctggcacc 781 tgtaccaccc tcgccagggc agcttctgcc cgaggagcac aggtcattga gaactgccca 841 gtgaccggca ttcgtgtgtg gacggatgat tttggggtgc ggcgggtcgc gggtgtggag 901 actcagcatg gttccatcca gacaccctgc gtggtcaatt gtgcaggagt gtgggcaagt 961 gctgtgggcc ggatggctgg agtcaaggtc ccgctggtgg ccatgcacca tgcctatgtc 1021 gtcaccgagc gcatcgaggg gattcagaac atgcccaatg tccgtgatca tgatgcctct 1081 gtctacctcc gcctccaagg ggatgccttg tctgtgggtg gctatgaggc caccccatc 1141 ttttggagg aggtgtcaga caagtttgcc ttcggcctct tgacctgga ctgggaggtg 1201 ttcacccagc acattgaagg cgccatcaac agggtccccg tgctggagaa gacaggaatc 1261 aagtccacgg tctgcggccc tgaatccttc acgcccgacc acaagcccct gatgggggag 1321 gcacctgagc tccgagggtt cttcctgggc tgtggcttca acagcgcagg gaaggtccag 1381 acagtcctgc cactcctgtt taccgtcaac gtctatctgt atctgtaggt caggaggaca 1441 aacataggtc aataaatatg taatgttagt gaacg
```

-continued

SEQ ID NO: 611 AL136566 *Homo sapiens* mRNA; cDNA DKFZp761J191
(from clone DKFZp761J191)
(SEQ ID NO: 611)

```
   1 gccggagccc ggaccaggcg cctgtgcctc ctcctcgtcc ctcgccgcgt ccgcgaagcc
  61 tggagccggc gggagccccg cgctcgccat gtcgggcgag ctcagcaaca ggttccaagg
 121 agggaaggcg ttcggcttgc tcaaagcccg gcaggagagg aggctggccg agatcaaccg
 181 ggagtttctg tgtgaccaga agtacagtga tgaagaaac cttccagaaa agctcacagc
 241 cttcaaagag aagtacatgg agtttgacct gaacaatgaa ggcgagattg acctgatgtc
 301 tttaaagagg atgatggaga agcttggtgt ccccaagacc cacctggaga tgaagaagat
 361 gatctcagag gtgacaggag gggtcagtga cactatatcc taccgagact tgtgaacat
 421 gatgctgggg aaacggtcgg ctgtcctcaa gttagtcatg atgtttgaag aaaagccaa
 481 cgagagcagc cccaagccag ttggcccccc tccagagaga acattgcta gcctgccctg
 541 aggaccccgc ctggactccc cagccttccc accccatacc tccctcccga tcttgctgcc
 601 cttcttgaca cactgtgatc tctctctctc tcatttgttt ggtcattgag ggtttgtttg
 661 tgttttcatc aatgtctttg taaagcacaa attatctgcc ttaaagggc tctgggtcgg
 721 ggaatcctga gccttgggtc ccctccctct cttcttccct ccttcccgc tccctgtgca
 781 gaagggctga tatcaaacca aaaactagag gggcagggc cagggcaggg aggcttccag
 841 cctgtgttcc cctcacttgg aggaaccagc actctccatc ctttcagaaa gtctccaagc
 901 caagttcagg ctcactgacc tggctctgac gaggacccca ggccactctg agaagacctt
 961 ggagtaggga caaggctgca gggcctcttt cgggtttcct tggacagtgc catggttcca
1021 gtgctctggt gtcacccagg acacagccac tcggggcccc gctgccccag ctgatcccca
1081 ctcattccac acctcttctc atcctcagtg atgtgaaggt gggaaggaaa ggagcttggc
1141 attgggagcc cttcaagaag gtaccagaag gaaccctcca gtcctgctct ctggccacac
1201 ctgtgcaggc agctgagagg cagcgtgcag ccctactgtc ccttactggg gcagcagagg
1261 gcttcggagg cagaagtgag gcctggggtt tgggggaaa ggtcagctca gtgctgttcc
1321 acctttagg gaggatactg aggggaccag gatgggagaa tgaggagtaa aatgctcacg
1381 gcaaagtcag cagcactggt aagccaagac tgagaaatac aaggttgctt gtctgaccc
1441 aatctgcttg aaacctgact ctgcttctct catttgtctt cctaccctac tcacataatt
1501 cactcattga ctcactcatt caccagatat ttattgacct gctattataa gctttacatc
1561 ctcccatgtt gtcctggcat gtgcagtata acggtctaa ctcatctctc cccagatctc
1621 tcagaacctt gagcttggga attgaactgg ggtcacctgi gtcctttctt atggactcgc
1681 aggatttag aaccctaatg caccctggag ggtagctggg ccagacttct catttcacag
1741 gtgaggagac tggtgcccca cagggattaa gtgccttgcc caaggtcagg cttatctcca
1801 gagggaggtg ccctggactg gggcccagat gttcaggac cctgcctaca cctcatttcc
1861 agtgtgggct gccttagtta gttatgagaa cagggaaggg ctgggaagag acagcctcca
1921 aggtcaacac ttggagaggg tttcacttgc tctgaagacc ctggtccagg attcgccctc
1981 tcccatgcct tcaagtcagc atcaggctta gggcaaagac caggcctctg aagctgcctc
2041 ttgtaattca tgcaggaaga tgtcaaagtc agccccatct tggctgatca gggtgttcag
2101 ccttaacccc acctgtgttc tgaagtctct taccctacct gctcaggact gagacagtta
2161 ttcactgaac atatttatta agcacttgct gtaggccaac agttaagaat ccaataatga
2221 aatggacaga ttcatggaac ttagagtcca ataggaaagt gagacccaga caatgacaat
```

-continued

```
2281 gagataaatg ttaggaaggg ggaggtatgg ggtgacttcc ctgcagtcct gggggcctac
2341 atgggcccaa gactgggtga gagtcttggc agagcctttg caacaccttá agtggacagg
2401 actgggaggt cttggtggtt ggagccaacg tgggttccct gcggctcctt agtcacctct
2461 gatagcagat tgaggaggaa aaacaggtaa ggcatgagga aatggccagg ttgggttaac
2521 ccactggttt caaccagttc aggaatgagg ttatttggcc atgactggct gatcttgagc
2581 tcaaggatct gcttcaaatg cacacaggcc tagttgaagt ttaaacccca gcaaaacatt
2641 cctccctgta aatggaaaat cctacttcta cccccacccct gccctgtttt ttgttttttt
2701 tttccccaag atcattagat gtcctcaccc ctcctcactg cctctcctct ctgggacagg
2761 ctgggacctt tgaggaagat aaagccttcc ttgactaccc atcatattca gtgtccctgt
2821 tcctcactca gagaggaagg cagaaccagt caggcttatt tcagtaagtt ccacagttct
2881 acaagactgc aggaattctc cttaagggag gagagcaagc aggtgtggcc ccagcttctg
2941 gaaatggcag aagagagggt tttctcattg aatgggggtg ggggctcgtg tgtcctggga
3001 aaccccatca gtcccttcat ttcttgagac tcaactcctg ggaggagagg gtctcaagag
3061 ttgtccctgg aaggagggcg ggggcagtct gcatctattt caggttgtgg ctcttggttc
3121 taggactctt acttctctgg ctaagggctc agcttcttgg gacttcaacc atcttctttc
3181 tgaaagacca aatctaatgt aaccagtaac gtgaggactg ccaagtatgg ctttgtccct
3241 atgactcaga ggagggtttg tcgggcaaat tcaggtggat gaagtatgtg tgtgcgtgtg
3301 catgggagtg tgcgtggact gggatatcat ctctacagcc tgcaaataaa ccagacaaac
3361 ttaaaaaaaa aaaaaaaaa a
```

SEQ ID NO: 612 NM_005545 *Homo sapiens* immunoglobulin superfamily containing leucine-rich repeat (ISLR), transcript variant 1, mRNA (SEQ ID NO: 612)

```
   1 aagcagttgt tttgctggaa ggagggagtg cgcgggctgc cccgggctcc tccctgccgc
  61 ctcctctcag tggatggttc caggcaccct gtctggggca gggagggcac aggcctgcac
 121 atcgaaggtg gggtgggacc aggctgcccc tcgcccccagc atccaagtcc tcccttgggc
 181 gcccgtggcc ctgcagactc tcagggctaa ggtcctctgt tgcttttttgg ttccaccttá
 241 gaagaggctc cgcttgacta agagtagctt gaaggaggca ccatgcagga gctgcatctg
 301 ctctggtggg cgcttctcct gggcctggct caggcctgcc ctgagccctg cgactgtggg
 361 gaaaagtatg gcttccagat cgccgactgt gcctaccgcg acctagaatc cgtgccgcct
 421 ggcttcccgg ccaatgtgac tacactgagc ctgtcagcca accggctgcc aggcttgccg
 481 gagggtgcct tcagggaggt gccccctgctg cagtcgctgt ggctggcaca caatgagatc
 541 cgcacggtgg ccgccggagc cctggcctct ctgagccatc tcaagagcct ggacctcagc
 601 cacaatctca tctctgactt tgcctggagc gacctgcaca acctcagtgc cctccaattg
 661 ctcaagatgg acagcaacga gctgaccttc atccccgcg acgccttccg cagcctccgt
 721 gctctgcgct cgctgcaact caaccacaac cgcttgcaca cattggccga gggcaccttc
 781 accccgctca ccgcgctgtc ccacctgcag atcaacgaga ccccttcga ctgcacctgc
 841 ggcatcgtgt ggctcaagac atgggccctg accacggccg tgtccatccc ggagcaggac
 901 aacatcgcct gcacctcacc ccatgtgctc aagggtacgc cgctgagccg cctgccgcca
 961 ctgccatgct cggcgccctc agtgcagctc agctaccaac ccagccagga tggtgccgag
1021 ctgcggcctg gttttgtgct ggcactgcac tgtgatgtgg acgggcagcc ggcccctcag
1081 cttcactggc acatccagat acccagtggc attgtggaga tcaccagccc caacgtgggc
```

-continued

```
1141 actgatgggc gtgccctgcc tggcacccct gtggccagct cccagccgcg cttccaggcc 1201 tttgccaatg gcagcctgct tatccccgac tttggcaagc tggaggaagg cacctacagc 1261 tgcctggcca ccaatgagct gggcagtgct gagagctcag tggacgtggc actggccacg 1321 cccggtgagg gtggtgagga cacactgggg cgcaggttcc atggcaaagc ggttgaggga 1381 aagggctgct atacggttga caacgaggtg cagccatcag ggccggagga caatgtggtc 1441 atcatctacc tcagccgtgc tgggaaccct gaggctgcag tcgcagaagg ggtccctggg 1501 cagctgcccc caggcctgct cctgctgggc aaaagcctcc tcctcttctt cttcctcacc 1561 tccttctagc cccacccagg cttccctaa ctcctcccct tgcccctacc aatgcccctt 1621 taagtgctgc aggggtctgg ggttggcaac tcctgaggcc tgcatgggtg acttcacatt 1681 ttcctacctc tccttctaat ctcttctaga gcacctgcta tccccaactt ctagacctgc 1741 tccaaactag tgactaggat agaatttgat cccctaactc actgtctgcg gtgctcattg 1801 ctgctaacag cattgcctgt gctctcctct caggggcagc atgctaacgg ggcgacgtcc 1861 taatccaact gggagaagcc tcagtggtgg aattccaggc actgtgactg tcaagctggc 1921 aagggccagg attgggggaa tggagctggg gcttagctgg gaggtggtct gaagcagaca 1981 gggaatggga gaggaggatg ggaagtagac agtggctggt atggctctga ggctccctgg 2041 ggcctgctca agctcctcct gctccttgct gttttctgat gatttggggg cttgggagtc 2101 cctttgtcct catctgagac tgaaatgtgg ggatCCagga tggccttcct tcctcttacc 2161 cttcctccct cagcctgcaa cctctatcct ggaacctgtc ctccctttct ccccaactat 2221 gcatctgttg tctgctcctc tgcaaaggcc agccagcttg ggagcagcag agaaataaac 2281 agcatttctg atgccaaaaa aaaaaaaaaa aa
```

SEQ ID NO: 613 AF327066, *Homo sapiens* Ewings sarcoma EWS-Fli1 (type 1) oncogene mRNA, complete cds (SEQ ID NO: 613)

```
   1 atggcgtcca cggattacag tacctatagc caagctgcag cgcagcaggg ctacagtgct 61 tacaccgccc agcccactca aggatatgca cagaccaccc aggcatatgg caacaaagc 121 tatggaacct atggacagcc cactgatgtc agctataccc aggctcagac cactgcaacc 181 tatgggcaga ccgcctatgc aacttcttat ggacagcctc ccactggtta ctactccca 241 actgcccccc aggcatacag ccagcctgtc caggggtatg gcactggtgc ttatgatacc 301 accactgcta cagtcaccac cacccaggcc tcctatgcag ctcagtctgc atatggcact 361 cagcctgctt atccagccta tgggcagcag ccagcagcca ctgcacctac aagaccgcag 421 gatgaaaaca gcccactga ctagtcaa cctcaatcta gcacaggggg ttacaaccag 481 cccagcctag gatatggaca gagtaactac agttatcccc aggtacctgg gagctacccc 541 atgcagccaa tcactgcacc tccatcctac cctcctacca gctattcctc tacacagccg 601 actagttatg atcagagcag ttactctcag cagaacacct atgggcaacc gagcagctat 661 ggacagcaga gtagctatgg tcaacaaagc agctatgggc agcagcctcc cactagttac 721 ccaccccaaa ctggatccta cagccaagct ccaagtcaat atagccaaca gagcagcagc 781 tacgggcagc agagtcctcc ccttggaggg gcacaaacga tcagtaagaa tacagagcaa 841 cggccccagc cagatccgta tcagatcctg ggcccgacca gcagtcgcct agccaaccct 901 ggaagcgggc agatccagct gtggcaattc ctcctggagc tgctctccga cagcgccaac 961 gccagctgta tcacctggga ggggaccaac ggggagttca aaatgacgga ccccgatgag 1021 gtggccaggc gctggggggca gcggaaaagc aagcccaaca tgaattacga caagctgagc 1081 cgggccctcc gttattacta tgataaaaac attatgacca aagtgcacgg caaaagatat

```

-continued

```
1141 gcttacaaat tgacttcca cggcattgcc caggctctgc agccacatcc gaccgagtcg
1201 tccatgtaca agtacccttc tgacatctcc tacatgcctt cctaccatgc ccaccagcag
1261 aaggtgaact ttgtccctcc catccatcc tccatgcctg tcacttcctc cagcttcttt
1321 ggagccgcat cacaatactg gacctccccc acgggggaa tctaccccaa ccccaacgtc
1381 ccccgccatc ctaacaccca cgtgccttca cacttaggca gctactacta g
```

SEQ ID NO: 614 U73531 Human G protein-coupled receptor STRL33.3 (STRL33) mRNA, complete cds (SEQ ID NO: 614)

```
   1 atttttatta agcagtctta gcccaaaggc agcatcctttc cttgctagag agaaagggca
  61 ctttggtccc tggaaagaca gaggcaagca gcagcatcgg agacactgct cccagtcagg
 121 actcaaagtc agcgacagaa gtgtttctga gtggattagg aaaggtaacc tcatcgttta
 181 tatgcacttg tctggtcagg caatattttg actttgctgg cagagattct gtccaaacac
 241 ctgctcttct tcatacatct tctagaggtg ctggccagac atggctccag gtcactggaa
 301 atgagctgct gcatgttgag tatctgcagt cctgtagcaa gggcagactt ggcactcatg
 361 ggctgatgtt gccgcagctg ccctgctcc cacaccacag gttacatgat cccttgtcct
 421 gtccatggtc tttggcaggg tcacagggca gagggaaggg tcagagagaa gtgacatctt
 481 gaagggctgg tgcctgggta agaaaggttg cccatctggc atcccatttc aattgggttt
 541 tctgcttgtt aaatgaggcc cctaagtcct aacctgccaa tcacaggagc taaggcaagg
 601 ttccgctttg gggaaatcta ccttttaaga gacttcttgt tcagaagtct tcaggaaatg
 661 aggctctgat ggtagaatgc cataaactgt gttaactgat gaaggggaaa gtttagttgg
 721 gaagtgagga gaaccaccca atgctttaac catgaagcca gctcagccaa agtgctgggc
 781 agtcgtgggc ttttctatgc tttgtttccc cattagtagc ctttgaaaat ctatgcaatt
 841 gagggggaagt aaaggcagga aggactacct acccaggcag agcagtcttg ccatccccaa
 901 acacctgtgg tctccaggag tctccttgat aggagagccc cctggtaggg gcacttgctt
 961 tagctttcac aatttattag gaaatgggc tcaggatggg tgggcaactg tggtgaggca
1021 gggggagatg aaaacaggca tgttccattg atgagctcat attatcagtg gctcaaccat
1081 tccatcatca gtgttgctct tccaaacagc actgtgccca cctggcagca aagcgacttt
1141 tggtttcaaa ataattgagc acaggatttt atggaatgtg cttaggggtc agttatgagt
1201 tgtctcccag atgggtgaga tcctgagaat tttcaggcta atggagagtc ctcatcctgt
1261 ctgagcaatt tcccctcaga attggttatc ttcaatatac tggactgtgc tgtttctaca
1321 catcccagtg ggtgggttta aagatgact atttgccccc taaatgtggt caatgggata
1381 gcaggaagac aaagaatgcc atcctcagcc caaatataa ttcctgggtt ctgactcaca
1441 ggtgttcatc agaacagaca ccatggcaga gcatgattac catgaagact atgggttcag
1501 cagtttcaat gacagcagcc aggaggagca tcaagccttc ctgcagttca gcaaggtctt
1561 tctgccctgc atgtacctgg tggtgtttgt ctgtggtctg gtggggaact ctctggtgct
1621 ggtcatatcc atcttctacc ataagttgca gagcctgacg gatgtgttcc tggtgaacct
1681 acccctggct gacctggtgt tgtctgcac tctgcccttc tgggcctatg caggcatcca
1741 tgaatgggtg tttggccagg tcatgtgcaa agcctactg gcatctaca ctattaactt
1801 ctacacgtcc atgctcatcc tcacctgcat cactgtggat cgtttcattg tagtggttaa
1861 ggccaccaag gcctacaacc agcaagccaa gaggatgacc tggggcaagg tcaccagctt
1921 gctcatctgg gtgatatccc tgctggtttc cttgcccaa attatctatg caatgtctt
```

-continued

```
1981 taatctcgac aagctcatat gtggttacca tgacgaggca atttccactg tggttcttgc 2041 cacccagatg acactggggt tcttcttgcc actgctcacc atgattgtct gctattcagt 2101 cataatcaaa acactgcttc atgctggagg cttccagaag cacagatctc taaagatcat 2161 cttcctggtg atggctgtgt tcctgctgac ccagatgccc ttcaacctca tgaagttcat 2221 ccgcagcaca cactgggaat actatgccat gaccagcttt cactacacca tcatggtgac 2281 agaggccatc gcatacctga gggcctgcct taaccctgtg ctctatgcct tgtcagcct 2341 gaagtttcga agaacttct ggaaacttgt gaaggacatt ggttgcctcc cttaccttgg 2401 ggtctcacat caatgaaat cttctgagga caattccaag acttttctg cctcccacaa 2461 tgtggaggcc accagcatgt tccagttata ggccttgcca gggtttcgaa aaactgctct 2521 ggaatttgca aggcatggct gtgccctctt gatgtggtga ggcaggcttt gtttatagct 2581 tgcgcattct catggagaag ttatcagaca ctctggctgg tttggaatgc ttcttctcag 2641 gcatgaacat gtactgttct cttcttgaac actcatgctg aaagcccaag taggggtct 2701 aaaatttta aggactttcc ttcctccatc tccaagaatg ctgaaaccaa gggggatgac 2761 atgtgactcc tatgatctca ggttctcctt gattgggact gggg
```

SEQ ID NO:615 BC016797, *Homo sapiens* chromosome 7 open reading frame 19, mRNA (cDNA clone IMAGE:4070303), partial cds (SEQ ID NO: 615)
```
  1 gggggcttc ttcatgctct gatcacatct ctcgtaaaag cttaagctct ctccggggtc 61 cgggttggcc gtgccgtgga attctgggtg gcctggctgg ggtctctgga aatgtggctg 121 cagcagagaa cagagaccct gacatgcagt tttccgtgct gagggccct aggggagtca 181 caccaagggt ccccacgaga aagttgtggc atccccgggg gccggagaag agccccgtgt 241 cttctgagga gttcgtcctt tgtgtcccct gcagacattt gtctgcgacc tttgccctcc 301 agcatgtatg tactttcctg cagcctgtag aaacgcctct tacggtttaa tatgtgttcg 361 ctttgctaaa gaatatcaac atcggccagg cgaggtgggg cacgcctgtc atcccagcac 421 tttgggaggc tgaggtggga ggatcacttg gcccagggg tgcaagacca gcctgggcaa 481 catagcgaga ccccatgtct aaaaaaatta ttttaaatta gccaggcggg gtgcaatggc 541 tcgcgcccgt aatcttagca ctctgggagg ccgaggcagg cagatcactt gagatcagga 601 ctttaagacc agcctcggca acaacatggt gaaaccatct ctagcaaaaa tacaaaaaat 661 tagccgggta tggtggcggg tacctgtaat cccagctact caggaggctg aggcaagaga 721 atcgcttgaa cgcaggaggc agaggttgca gtgagctgag atcgtgccac tgcactccag 781 cctggacaac agagcaaaac tctgtctcaa aaataataa ataaaataa attagctggg 841 cgtggtggtg catgcctgta gttccagcta cttgggaggc tgaggtggga ggattgcttg 901 agcctgggaa gtagaggctg cagtgaacta taactgtgct agtggccggg cgcagtggct 961 cacgcctata atcccagcac tttgggaggc caaagcaggt ggatcacttg aggtcaggag 1021 ttcgagacca gcctggccaa catggtgaaa ctctgtgtct actaaaaata caaaaaaaa 1081 aaaaaaaaa aaaaaaaaa a
```

SEQ ID NO: 616 BE781857, *Homo sapiens* cDNA clone IMAGE:3873282 5-,mRNA sequence (SEQ ID NO: 616)
```
  1 tgtagccagc tcggctccct tccctgtgta tctgtgtcct gctaacagcc aagagatgtt 61 gcaagggagg aaaatgtgag agaccttgga acctgtcagg tttattgttt cgttttaaa 121 ggcatgtttg aagtttagtt ctttacccctt ctcctaaaat ctttttttaa tcagcctcaa 181 ggttaaaata aggagtgact acagtatgta aaataaggaa aggaagcatt aatggtgtga
```

```
241 tgtgacctgc ctgttttttt gtaaacaaga aataggaaa tgttttcaag gtagtttcac 301 atgtcttgca ccaagctcat gcctcttgct tttccttttt gactttatct ccctcagttt 361 ttcttctgct gtggccagaa agacagtcac tacagttgac tattgataca aaggtgcaac 421 agaaatatta tccctgcatt tttaaatata agaagtagac attaatcttt aaccatggtg 481 cctccctaat gtaagtgata tttcattggt ggtttcaaca aaggttaagc tcattacaga 541 cagaaatatt cgtctttatc ttccttttcc cctgcctcag tcgtgttatt caccccctatt 601 cttgatattt caaaggagga gaatcagtag cattttcctt atattataca catgtgtcta 661 tcccatttca ggtcaagtct tacacccaac tcatggcttc cagtaggaaa ataagacatt 721 ctgccttagt gttaaatgca agatagggct tctcttccgg atgaggactg gttgttctac 781 tctagtctgg gactaacatc cgactgggct acttaattaa ggacgacaga agtgctccaa 841 tttaaaacgt gtccaggata agagatcaca aaaggttggt cagaataggc ttttcacata 901 gacatcgagg tcccaacggg gggaattaaa cataggtatc tgatgttatc ataga SEQ ID NO: 617 NM_024660 Homo sapiens transmembrane protein 149
(TMEM 149), mRNA
                                                   (SEQ ID NO: 617)
  1 acacaacttc agctgaggaa cttggcacgg ccagcttggg acccaggacc ctaacgcaga 61 ggcgctgtgt ttggaagtcc cgctatcacg gccccccaga tggggcctgg acgatgcctc 121 ctgacggcct tgttgcttct ggccctggcg ccaccgccgg aagcctccca gtactgcggc 181 cgccttgaat actggaaccc agacaacaag tgctgcagca gctgcctgca acgcttcggg 241 ccgcccccct gcccggacta tgagttccgg gaaaactgcg gactcaatga ccacggcgat 301 ttcgtaacgc ccccgttccg aaagtgttct tctgggcagt gcaaccccga cggcgcggag 361 ctatgtagcc cctgcggcgg cggagccgtg acccctactc ccgccgcggg cggggggcaga 421 accccgtggc gctgcagaga gaggccggtc cctgccaagg ggcactgccc cctcacacct 481 ggaaacccag gcgcccctag ctcccaggag cgcagctcac cagcaagttc cattgcctgg 541 aggaccctg agcctgtccc tcagcaggcc tggccgaatt tccttccgct cgtggtgctg 601 gtcctgctcc tgaccttggc ggtgatagcg atcctcctgt ttattctgct ctggcatctc 661 tgctggccca aggagaaagc cgaccctat ccctatcctg gcttggtctg cggagtcccc 721 aacacccaca ccccttcctc ctcgcatctg tcctccccag cgccctgga cagggggac 781 acatggaagg aggcctcact acttccactc ctgagcaggg aactgtccag tctggcgtca 841 caaccctgt ctcgcctcct ggatgagctg gaggtgctgg aagagctgat tgtactgctg 901 gaccctgagc ctgggccagg tgggggtatg gcccatggca ctactcgaca cctggccgca 961 agatatgggc tgcctgctgc ctggtccacc tttgcctatt cgctgaggcc gagtcgctcg 1021 ccgctgcggg ctctgattga gatggtggtg gcaagggagc cctctgcctc cctgggccag 1081 cttggcacac acctcgccca gctagggcgg gcagatgcat tgcgggtgct gtccaagctt 1141 ggctcatctg ggttttgctg ggcttaacac ccaataaaga actttgctga ctactaaaaa 1201 aaaaaaaaaa aaaaaaaa SEQ ID NO: 618 NM_019099 Homo sapiens chromosome 1 open reading frame
183 (C1orf183), transcript variant 1, mRNA
                                                   (SEQ ID NO: 618)
  1 gaagcgactc tgagtcccgg gctcggagcg caggctcagc tccgcgctgc gagcgctacg 61 ggcgcagggg cggggagccg gcccggagcg cagtttccag tggggccggg gtttcacccg 121 ggccctctct gtttgaaccg aacccgacaa atgggcgcat gacgatggag agcagggaaa 181 tggactgcta tctccgtcgc ctcaaacagg agctgatgtc catgaaggag gtgggtgatg
```

-continued

```
 241 gcttacagga tcagatgaac tgcatgatgg gtgcactgca agaactgaag ctcctccagg
 301 tgcagacagc actggaacag ctggagatct ctggagggg tcctgtgcca ggcagccctg
 361 aaggtcccag gacccagtgc gagcaccctt gttgggaggg tggcagaggt cctgccaggc
 421 ccacagtctg ttcccctcc agtcaacctt ctcttggcag cagcaccaag tttccatccc
 481 ataggagtgt ctgtggaagg gatttagccc ccttgcccag gacacagcca catcaaagct
 541 gtgctcagca ggggccagag cgagtggaac cggatgactg gacctccacg ttgatgtccc
 601 ggggccggaa tcgacagcct ctggtgttag ggacaacgt ttttgcagac ctggtgggca
 661 attggctaga cttgccagaa ctggagaagg gtggggagaa gggtgagact ggggggggcac
 721 gtgaacccaa aggagagaaa ggccagcccc aggagctggg ccgcaggttc gccctgacag
 781 caaacatctt taagaagttc ttgcgtagtg tgcggcctga ccgtgaccgg ctgctgaagg
 841 agaagccagg ctgggtgaca cccatggtcc ctgagtcccg aaccggccgc tcacagaagg
 901 tcaagaagcg gagcctttcc aagggctctg gacatttccc cttccaggc accggggagc
 961 acaggcgagg ggagaatccc cccacaagct gccccaaggc cctggagcac tcaccctcag
1021 gatttgatat taacacagct gtttgggtct gaatcctaga gacagaaagt tgactgagcc
1081 tgaaagggcc aggtcccagt gctgggcccc tggggaggag ggagggtggg cggtatggct
1141 ctcgaaagcc caactccaag ttccttccc ccagaaagcg gggagaagcc agagttcttg
1201 gctcaggact gaagggaagg tggttgggag aggctgtctt gggggctagc tggtggagga
1261 ggtaagagta gctggagagt gagctgtgcg tgtgtgtgtg tgtgtgtgca tgtgtgtgtc
1321 tgtctggcat gcatgcactc actttgggc tggaggtgac agtaggtgag ggcagaggag
1381 gagatcagaa aatccctctg acatctccac tgccccaaa gacctccgtt gaacattctg
1441 tatggaaaag agccctggag catcaggttc cccagatagg cccccaaata aagacctgtc
1501 tatggctctc ccaaccttct gtcagcttct ttggcaagac attgctccag gcacagggac
1561 tgaaccccag gcctcctggg actggagcag cagtgaggca aaacccgacc tgctagccct
1621 ttctgccttg gaggtttcag tccatacctg gactctgaga aaatgagctg aataaggagt
1681 acagtgtgta aggagcagcc agggaagccc tagacactcc ccgcgtctcc cccatgcaca
1741 ggggaaggat gttgacatag cactgggctg tttgaatgcc ttttcatctc catggtctca
1801 tttgaaagtg agcgaggcag gcaggcatga tcccatttc cagataagga aacaagccta
1861 gatatgctac atgtccagga acaactgcag ccaggaggca gaacagccta ggtctaactg
1921 cagagtagaa gctggaccct ggagttacca acactcctcc ccaacagttc ttagcgcccc
1981 gcaggctggg cgctgtggct cacgcctgta atcccagcac tttgggaggg caaggcaggc
2041 ggattacctg gggtcaggag ttcatgacca gcctggccaa catggtgaaa ccccgtctct
2101 actaaaaaaa tacgtaaaaa ttagccaggc gtggtggcac acgcctgtaa acccagctac
2161 tcgggaggct gaggcaggag aattgcttga gcccgggaga gggaggttgc agtgagccga
2221 gatcatgcca ctgcactcca gcctggctga cagagcaaga ctcccctgtc tc
```

SEQ ID NO: 619 AL133001 Novel human gene on chromosome 20, similar to GLUCOSAMINE-6-SULFATASES (SEQ ID NO: 619)

```
   1 tacaaggcca gctatgtccg cagtcgctcc atccgctcag tggccatcga ggtggacggc
  61 agggtgtacc acgtaggcct gggtgatgcc gcccagcccc gaaacctcac caagcggcac
 121 tggccagggg ccctgaggga ccaagatgac aaggatggtg gggacttcag tggcactgga
 181 ggccttcccg actactcagc cgccaacccc attaaagtga cacatcggtg ctacatccta
 241 gagaacgaca cagtccagtg tgacctggac ctgtacaagt ccctgcaggc ctggaaagaC
```

-continued

```
 301 cacaagctgc atatcgacca cgagattgaa accctgcaga acaaaattaa gaacctgagg
 361 gaagtccgag gtcacctgaa gaaaaagcgg ccagaagaat gtgactgtca caaaatcagc
 421 taccacaccc agcacaaagg ccgcctcaag cacagaggct ccagtctgca tcctttcagg
 481 aagggcctgc aagagaagga caaggtgtgg ctgttgcggg agcagaagcg caagaagaaa
 541 ctccgcaagc tgctcaagcg cctgcagaac aacgacacgt gcagcatgcc aggcctcacg
 601 tgcttcaccc acgacaacca gcactggcag acggcgcctt tctggacact ggggcctttc
 661 tgtgcctgca ccagcgccaa caataacacg tactggtgca tgaggaccat caatgagact
 721 cacaatttcc tcttctgtga atttgcaact ggcttcctag agtactttga tctcaacaca
 781 gaccccctacc agctgatgaa tgcagtgaac acactggaca gggatgtcct caaccagcta
 841 cacgtacagc tcatggagct gaggagctgc aagggttaca agcagtgtaa cccccggact
 901 cgaaacatgg acctgggact taaagatgga ggaagctatg agcaatacag gcagtttcag
 961 cgtcgaaagt ggccagaaat gaagagacct tcttccaaat cactgggaca actgtgggaa
1021 ggctgggaag gttaagaaac aacagaggtg gacctccaaa acatagagg catcacctga
1081 ctgcacaggc aatgaaaaac catgtgggtg atttccagca gacctgtggt attggccagg
1141 aggcctgaga aagcaagcac gcactctcag tcaacatgac agattctgga ggataaccag
1201 caggagcaga gataacttca ggaagtccat ttttgcccct gcttttgctt tggattatac
1261 ctcaccagct gcacaaaatg cattttttcg tatcaaaaag tcaccactaa ccctcccca
1321 gaagctcaca aaggaaaacg gagagagcga gcgagagaga tttccttgga aatttctccc
1381 aagggcgaaa gtcattggaa ttttttaaatc ataggggaaa agcagtcctg ttctaaatcc
1441 tcttattctt ttggtttgtc acaaagaagg aactaagaag caggacagag caacgtggaa
1501 gaggctgaaa acagtgcaga gacgtttgac aatgagtcag tagcacaaaa gagatgacat
1561 ttacctagca ctataaaccc tggttgcctc tgaagaaact gccttcattg tatatatgtg
1621 actatttaca tgtaatcaac atgggaactt ttaggggaac ctaataagaa atcccaattt
1681 tcaggagtgg tggtgtcaat aaacgctctg tggccagtgt aaaagaaaa
```

SEQ ID NO: 620 NM_024587 Homo sapiens transmembrane protein 53 (TMEM53), mRNA (SEQ ID NO: 620)

```
   1 ggctggagac ccgtgctctg ggccggcgcc ttcaccatgg cctcggcaga gctggactac
  61 accatcgaga tcccggatca gccctgctgg agccagaaga acagccccag cccaggtggg
 121 aaggaggcag aaactcggca gcctgtggtg attctcttgg gctggggtgg ctgcaaggac
 181 aagaaccttg ccaagtacag tgccatctac cacaaaaggg gctgcatcgt aatccgatac
 241 acagcccccgt ggcacatggt cttcttctcc gagtcactgg gtatcccttc acttcgtgtt
 301 ttggcccaga agctgctcga gctgctcttt gattatgaga ttgagaagga gccctgctc
 361 ttccatgtct tcagcaacgg tggcgtcatg ctgtaccgct acgtgctgga gctcctgcag
 421 acccgtcgct tctgccgcct gcgtgtggtg ggcaccatct ttgacagcgc tcctggtgac
 481 agcaacctgg tagggctct gcgggccctg gcagccatcc tggagcgccg ggccgccatg
 541 ctgcgcctgt tgctgctggt ggcctttgcc ctggtggtcg tcctgttcca cgtcctgctt
 601 gctcccatca cagccctctt ccacacccac ttctatgaca ggctacagga cgcgggctct
 661 cgctggcccg agctctacct ctactcgagg gctgacgaag tagtcctggc cagagacata
 721 gaacgcatgg tggaggcacg cctggcacgc cgggtcctgg cgcgttctgt ggatttcgtg
 781 tcatctgcac acgtcagcca cctccgtgac taccctactt actacacaag cctctgtgtc
```

```
                                         -continued
 841 gacttcatgc gcaactgcgt ccgctgctga ggccattgct ccatctcacc tctgctccag 901 aaataaatgc ctgacacctc cccacaacct gcaatctgtc gggcactctt ctcgttcaac 961 tccctgtagc cctttgggac tttgcggtcc cctaagtaga aaattcctat gggcctgtct 1021 cctgggggcc tctgtctgct ggtggtctgc ttaccacaga atcctaaggg gcaggagtgc 1081 ctgggcatgt gtctgtggga gccttgcagt cagttgtgtt tggacaagtg caacagtcag 1141 gctgctgatt cctgtggcat gcaggctgta gaggttgaca aatggagggg ggtgttgagg 1201 gtgagcccta gttgattttt taaaatttaa actctggtaa gaacatttaa tatgagacct 1261 actctctttt tttctttact tatttattta tctatttatt tcaagacagg gtctcactct 1321 gtcacctagg ctggggtgca atggtgcaat catggctcac tgcagcctca acctcccagg 1381 ctcaagtgat cctcccacct cagcctccca aagtgctagg attacaggca tgagtcaccg 1441 cgcctggcca agatcaccta acaaaattgt aagtgtgtac gatacttaaa atttaagaga 1501 ttatgtgcac ggcagacctc tagaactgaa tagtcttgca tcttgcataa ttcagaactt 1561 catcatcttg cataactgaa actttgtgcc tgttaccaga aaaaaaaaaa aaaa
```

SEQ ID NO: 621 A1954412 *Homo sapiens* cDNA clone IMAGE:2490992
3-, mRNA sequence (SEQ ID NO: 621)

```
   1 tttttttttt tttttttttt tttttttttt ttacacactc attcaaacct ttattaagta 61 cctaccatat gtacaatact gttccaaata ttaagggaat acaaagatga atttttaaat 121 ggggccaaat cccaagggt ttacaatata ataatagtaa aaagtaattt aacacgaact 181 gtgggaagaa aattacaagt aaacatttgc ccctgatgga gaaaaatgac cttattttta 241 aatttaaagc ataaattgcc agt
```

SEQ ID NO: 622 AI393309 *Homo sapiens* cDNA clone IMAGE:2 108789
3-similar to WP:ZK909.3 CE15477 GUANOSINE-3-,5--BIS(DIPHOSPHATE)-
PYROPHOSPHOHYDROLASE LIKE;, mRNA sequence (SEQ ID NO: 622)

```
   1 aaaccttaac ccagagttat ttttattttc cagaacgtgt taggaactag tacttaaata 61 atctcaagtc cctgaggggc cagagatccc accatgcaaa atagcaaaca gacccaagac 121 ttggggagag gcggtgagtg catcagaaat ggatgggtac atctgattcc caccacgcgg 181 ggctcagctt agttagcagg agaccttcag actgagaaaa aatgcaagtc tttttttggc 241 ctctaatatc tggaaggat ggagggagct caggagacac agaaaagatg gcgtatgaat 301 cctgtccggc ctgaacgagg ctggagttgt gcctctggat agcttcaagc actgatcaga 361 ttgtcagccc ccgctgcttg aacagatgct ttagagcctc ttccagttgc cggtttgttc 421 cctgaagccc cttcaccacc tgcgctgccc actcgaagta ttcctggact cgatgttctg 481 accatccctc tggggtgcag cgattcaggt ccctcagatt gtacagcttg tctgccagct 541 tcaccagttt ggccccgggg ctactgtggn gcgcttggct cacctgcagc ctctntctct 601 ccagcttggg cagagtcttg tcatctggta cctnctncac caggcgccgc acttgtgccc 661 caaagtgtag cttcaccctc atccaggtgg tgtctgtgtc ctccaccgtg tcatggagca 721 gggc
```

SEQ ID NO: 623 NM_030581 *Homo sapiens* WD repeat domain 59 (WDR59),
mRNA (SEQ ID NO: 623)

```
   1 cggggctgat tctctggctg tgtggggcg acggtcccgg gatactgggg acggcggggt 61 gggagggcgc cgtcctgggg ccgcggcggc cgggcggggg agatggcggc gcgatggagc 121 agcgaaaacg tggttgtaga gttccgtgac tcccaggcaa ctgcgatgtc tgtggactgt 181 cttgggcagc atgcagtgct ttctggccgc agattcttat acatcgtcaa tctagatgcc
```

-continued

```
 241 cctttcgaag gtcaccgaaa gatctctcgc cagagcaaat gggacattgg agctgtgcag
 301 tggaatcctc atgacagctt tgcacactat tttgcggctt cgagtaacca acgagtagac
 361 ctttacaagt ggaaagacgg cagtggggaa gttggcacaa ccttacaagg ccacactcgt
 421 gtcatcagcg acttggactg ggcggtgttt gagcctgacc tcctggttac cagctctgtg
 481 gacacctaca tctacatttg ggatatcaaa gacacaagga aacctactgt tgcactgtct
 541 gctgttgcgg gtgcctccca ggtcaaatgg aataaaaaaa atgctaactg ccttgccacc
 601 agccatgacg gcgatgtgcg gatatgggat aagaggaaac ccagtacagc agtggaatat
 661 ctagccgccc acctctccaa aatccatggc ctggactggc acccagacag cgagcacatt
 721 cttgctacct ccagtcaaga caattctgtg aagttctggg attaccgcca gcctcggaaa
 781 tacctcaata ttcttccttg ccaggtgcct gtctggaagg ccagatacac acctttcagc
 841 aatggattgg tgactgtgat ggttccccag ctgcggaggg aaaacagcct tctcctgtgg
 901 aatgtctttg acttgaacac cccagtccac accttcgtgg ggcatgatga tgtggtcctg
 961 gagttccagt ggaggaagca gaaggaaggg tccaaggact atcaactggt gacgtggtcc
1021 cgggatcaga ccttgagaat gtggcgggtg gattcccaga tgcagaggct ttgtgcaaat
1081 gacatattag atggtgttga tgagttcatt gagagtattt cccttctgcc ggaacctgag
1141 aagaccctgc acactgaaga tacagatcac cagcacactg caagccatgg ggaggaagaa
1201 gccctaaaag aagatccccc tagaaatctc ctggaagaga ggaaatcaga tcaactgggg
1261 ctgcctcaga ccttgcagca ggaattctcc ctgatcaatg tgcaaatccg gaatgtcaat
1321 gtggagatgg atgcggcaga caggagctgc acagtgtctg tgcactgcag caaccatcgt
1381 gtcaagatgc tggtgaagtt ccctgcacag tacccaaaca cgccgcccc ttccttccag
1441 tttattaacc ccacaaccat cacatccacc atgaaagcta agctgctgaa gatcctgaag
1501 gacacagccc tgcagaaagt gaagcgtggc cagagctgcc tggagccctg cctgcgccag
1561 ctcgtctcct gccttgagtc ctttgtgaac caggaagaca gcgcttccag caacccgttt
1621 gcactcccca actctgtcac tccccccttt ccgacgtttg cgcgggtgac cacggcttac
1681 gggtcgtacc aggacgccaa cattcccttt cctaggactt ctggggccag gttctgcgga
1741 gcaggttacc tggtatattt cacaaggccc atgacaatgc atcgggcggt gtctcccaca
1801 gagcctactc cgagatctct ctcagccttg tctgcttatc acactggctt gatcgcgccc
1861 atgaagatcc gcacagaggc ccctgggaac cttcgtttat acagtgggag ccccactcgc
1921 agcgagaaag agcaggtctc catcagctcc ttctactaca aggagcggaa atcaagacga
1981 tggaaaagta agcgtgaggg atcagactct ggcaatcgac agatcaaggc tgctgggaaa
2041 gtcatcatcc aggatattgc ttgcctcctg cctgttcaca aatcgctggg agagctgtac
2101 atattgaatg tgaatgatat tcaggaaaca tgtcagaaga atgccgcctc tgccttgctc
2161 gttggaagaa aggatcttgt ccaggtttgg tcgctggcta cggtagctac agatctttgc
2221 cttggtccga aatctgaccc agatttggaa acaccctggg ctcgacatcc atttgggcgg
2281 cagctgctgg agtccctgtt ggctcactat tgccggctcc gggatgttca gacactggcg
2341 atgctctgta gcgtgtttga agcccagtct cggcctcagg ggctaccaaa ccccttgggg
2401 ccttttccta accgttcttc taatcttgtg gtgtcccata gtcgatatcc tagctttacc
2461 tcttctggtt cctgctccag tatgtcagac ccagggctca cactggcgg ctggaacata
2521 gcgggaagag aggcagagca cttgtcctcc ccttggggag aatcctcacc agaagagctc
2581 cgctttggga gtctgaccta cagtgatccc cgtgagcgag aacgcgacca gcatgataaa
```

-continued

```
2641 aataaaaggc tcctggaccc cgccaatacc cagcaatttg atgactttaa gaaatgctat 2701 ggggaaatcc tctaccgttg gggtctgaga gagaagcgag ctgaagtgtt gaagtttgtc 2761 tcctgtcctc ctgaccctca caaagggatc gagttcggcg tgtactgcag ccactgccgg 2821 agtgaggtcc gtggcacgca gtgtgccatc tgcaaaggct tcacgttcca gtgtgccatc 2881 tgtcacgtgg ctgtgcgggg atcgtccaat ttctgcctga cctgtgggca cggtggccac 2941 accagccaca tgatggagtg gtttcggacc caggaggtgt gtcccaccgg gtgtgggtgc 3001 cactgcctgc ttgaaagcac tttctgaacc tacagaagtt gggtattgtc tgaaatccca 3061 gaggacccat aagtgccggt gacaagctgt ctgtcagggg agaggctcca gaacctgggt 3121 tcgtcccag tgagaccgga ggatgatccc ccaaggactg cgcagcatca gctcttggtg 3181 ggcctctgcc ttctcttctg tttggccacc tggtgtggat gtcactgtgt gaagataagg 3241 acagaagtgc agagctgcgc tttgtgtgtt gtctatgtcg gctgagctac caaggtggaa 3301 gttttcatgg agaaaagcac ctggctccag ggccagtgtt acagtgttac cctgtaaggt 3361 gttagcctta aaccaccgag cagcgttctc ttgatgccag tgcagagacc agagtcagat 3421 gcccgaggac agtgggtagg aatttcatca acaaatggac ctatggcatc atggctttag 3481 aagctggtac atttactgag ctgatggaca gtggccttct aaaatatgac acttaaattg 3541 taaatatgca ctgtacttaa ggattcttaa gatgtatttt tttgttattt ctcctccagc 3601 tgctatccct tggctaataa aattctagta atttgaaaaa aaaaaaaag agagaaagtt 3661 aaaaaaaaaa aaaaaaaa
```

SEQ ID NO: 624 NM_017585 Homo sapiens solute carrier family 2
(facilitated glucose transporter), member 6 (SLC2A6), mRNA (SEQ ID NO: 624)

```
   1 ctgagcgccc tccgctcgcc ccgagagaga cccggccatg caggagccgc tgctgggagc 61 cgagggcccg gactacgaca ccttccccga gaagccgccc ccgtcgccag gggacagggc 121 gcgggtcggg accctgcaga acaaaagggt gttcctggcc accttcgccg cagtgctcgg 181 caatttcagc tttgggtatg ccctggtcta cacatcccct gtcatcccag ccctggagcg 241 ctccttggat cctgacctgc atctgaccaa atcccaggca tcctggtttg ggtccgtgtt 301 caccctggga gcagcggccg gaggcctgag tgccatgatc ctcaacgacc tctgggccg 361 gaagctgagc atcatgttct cagctgtgcc gtcggcggcc ggctatgcgc tcatggcggg 421 tgcgcacggc ctctggatgc tgctgctcgg aaggacgctg acgggcttcg ccgggggggct 481 cacagctgcc tgcatcccgg tgtacgtgtc tgagattgct ccccaggcg ttcgtgggc 541 tctgggggcc acacccagc tcatggcagt gttcggatcc ctgtccctct acgcccttgg 601 cctcctgctg ccgtgcgct ggctggctgt ggccggggag gcgcctgtgc tcatcatgat 661 cctgctgctc agcttcatgc caactcgcc gcgcttcctg ctctctcggg gcagggacga 721 agaggccctg cgggcgctgg cctggctgcg tgggacggac gtcgatgtcc actgggagtt 781 cgagcagatc caggacaacg tccggagaca gagcagccga gtatcgtggg ctgaggcacg 841 ggccccacac gtgtgccggc ccatcaccgt ggccttgctg atgcgcctcc tgcagcagct 901 gacgggcatc acgccatcc tggtctacct gcagtccatc ttcgacagca ccgctgtcct 961 gctgccccc aaggacgacg cagccatcgt tggggccgtg cggctcctgt ccgtgctgat 1021 cgccgccctc accatggacc tcgcaggccg caaggtgctg ctcttcgtct cagcggccat 1081 catgtttgct gccaacctga ctctggggct gtacatccac tttggcccca ggcctctgag 1141 ccccaacagc actgcgggcc tgaaaagcga gtcctgggg gacttggcgc agccctggc 1201 agcacccgct ggctaccctca ccctggtgcc cctgctggcc accatgctct tcatcatggg
```

-continued

```
1261 ctacgccgtg ggctggggtc ccatcacctg gctgctcatg tctgaggtcc tgccctgcg
1321 tgcccgtggc gtggcctcag ggctctgcgt gctggccagc tggctcaccg ccttcgtcct
1381 caccaagtcc ttcctgccag tggtgagcac cttcggcctc caggtgcctt tcttcttctt
1441 cgcggccatc tgcttggtga gcctggtgtt cacaggctgc tgtgtgcccg agaccaaggg
1501 acggtccctg gagcagatcg agtccttctt ccgcatgggg agaaggtcct tcttgcgcta
1561 ggtcaaggtc cccgcctgga gggggccaaa cccccagtgg ctgggcctct gtgttggcta
1621 caaacctgca ccctgggacc aagaggcagc agtcatccct gccaccagcc agagcacagg
1681 aagagcagtg tgatgggggcc tcagcagcgg gtgcccctgg ctcgggacag gtagcactgc
1741 tgtccagcca cagccccagc ccaggcagcc cacagtgctg cacgtagcca tgggccgcag
1801 gagtgcatac aaccctgcat ccagggacac ggccctgctg ggtgacctca ggcctagtcc
1861 ctttcccttg cgtgaaggac acgcccaca gaaggctacg gggaggactg agaggacagg
1921 gctggaggca gccaagtaac gtagtcatat catcgcgctc tgatctggtg gcatctggct
1981 gtgcaaggaa gacccggctt tgccctcaca agtcttatgg gcaccacagg gaacatcctg
2041 gacttaaaaa gccagggcag gccgggcaca gtggctcacg cctgtaatcc cagcactttg
2101 ggaggccaaa gcaggtggat tacccaaggc caggagttca agaccagcct ggccaacatg
2161 gtgaaacccc gtctctacta aaaaatacaa aaaagctggg tgtggtggca cacaccgta
2221 gttccagcta cttgggaggc tgaggcagca ttgcttgaac ccgggaggtg gaggctgcaa
2281 tgagctgaga tcatgccatt gcactccagc ctgggcaacg agagtgaaac tccgtcccca
2341 cccctgcca aaaaaaaaa aaaaaagcc agggcaaagg acctggcgtg gccacttcct
2401 cctgccccag cccaacctct gggaacaggc agctcctatc tgcaaactgt gttcaccctt
2461 ttgtaaaaat aaaggaactg gacccgt
```

SEQUENCE LISTING (624 sequences)

SEQ ID NO: 1 - DNA, 1704 bp, Mus musculus
gcggggccgtggctgctcctccacgcgtagccccgcacctgctgccccagtccagcccggagctccgcggccatgcggctggcgctgctctgggctctgggactcctgggcgcgggcagccctcggccctccccgccgctgccaaatataggaggcactgaggaagagcagcaagccagcccagagaggacgctgagtggatccatggagagccgggttgttcaggacagccccccaatgagcctagcagacgtgcttcagactggtttacctgaggccctgaggatttccttggagctggacagtgagagtcatgtcctggagcttctacaaaatagagatctaatccctggccgcccaactctggtgtggtaccagcctgatggcacccgaatggtcagcgagggctacagtctagaaaactgctgctaccgaggacgagtgcagggccaccccagctcctgggtgtccctctgtgcctgctctgggatcagggggctcattgtcctgtccccagagagaggctatacactggagctgggccctggggaccttcagcgtcctgtcatttctcggatccaagaccacctgttgctgggccacacctgtgccccaagctggcatgcctctgtgcccactcgggcaggaccagacctccttctggaacagcatcacgctcacaggcttaagcgagatgtagtaacagagacgaaaattgtggagttggtgattgtggctgataattcagaggtcagaaagtaccctgacttccaacaactgctgaaccggacactagaagcggctctcttgctagacacgttcttccagcccttgaatgtccgggtagcccttgtgggcctagaggcatggacccagcacaacctgatagaaatgagctccaacccagctgtcctgctagacaacttcctccgctggcgccggacagacttgctgcctcgactgccccatgacagtgcccaactggtgactgtaacttccttctctggtcccatggtgggcatggccattcagaattccatctgttcccctgacttctccggaggtgtgaatatggaccactccacaagcatcttaggcgttgcctcctcgattgcccatgaattgggccacagtctgggtttggaccatgattctcccgggcacagctgtccctgtccaggtccagccccggctaagagctgcatcatggaggcctccacagacttcctaccaggtttgaacttcagcaactgcagccgacaggccctggaaaaggccctcctggaaggaatgggcagctgcctcttcgaacggcacccaccaggtgacctgcctggcccaggagatggaagcttgccgctggtggtgccctccaggccagctccaccaccccctgcagcatcttcgctctacctctgacctctggagatttggctgcctccttctcaagctctaagactcaaagaaatggaacctctgccccaaacactagagaagcaggagaacagacaatctggtgtccagccctaaagaaccaccaggcgctgttaagcaatacctggggacgcactaaaatagctgcagcgggatgctggggaggggccgaagccggggctggagtaggtggcggaaggacatggacactgtctatctctgctctgttgtaataaatgtgagatcttggaaaaaaaaaaaaaaaaaaaa

SEQ ID NO: 2 - DNA, 2064 bp, Mus musculus
gacatcccactgccagcactgcctgcggtgaaggaaccagcagccatgaagtggatcacacccgcttccctcatcctcctgctacatttcgctgcgtccaaagcattgcacgaaaatgagtttgggatagcttccacgttagattcctcccagtgcgtgacggagaagaatgtgcttagcatagctaccatcacctttacccagtttgttccggaagccaccgaggaggaagtgaacaaaatgactagcgatgtgttggctgcaatgaagaaaaactctggcgatgggtgtttagaaagccagctatctgtgtttctggatgaaatttgtcatgagacggaactctctaacaagtatggactctcaggctgctgcagccaaagtggagtggaaagacatcagtgtctgctggcacgcaagaagactgctccggcctctgtcccacccttccagtttccagaacctgccgagagttgcaaagcacatgaagaaaacagggcagtgttcatgaacaggttcatctatgaagtgtcaaggaggaaccccttcatgtatgccccagccattctgtccttggctgctcagtacgacaaggtcgttctggcatgctgcaaagctgacaacaaggaggagtgcttccagacaaagagagcatccattgcaaaggaattaagagaaggaagcatgttaaatgagcatgtatgttcagtgataagaaaatttgaatcccgaaacctccaggcaacaaccattattaagctaagtcaaaagttaactgaagcaaattttactgagattcagaagctggccctggatgtggctcacatccacgaggagtgttgccaaggaaactcgctggagtgtctgcaggatggggaaaaagtcatgacatatatatgttctcaacaaaatattctgtcaagcaaaatagcagagtgctgcaaattacccatgatccaactaggcttctgcataattcacgcagagaatggcgtcaaacctgaaggcttatctctaaatccaagccagtttttgggagacagaaattttgcccaattttcttcagaggaaaaaatcatgttcatggcaagctttcttcatgaatactcaagaactcaccccaaccttcctgtctcagtcattctaagaattgctaaaacgtaccaggaaatattggagaagtgttcccagtctggaaatctacctggatgtcaggacaatctggaagaagaattgcagaaacacatcgaggagagccaggcactgtccaagcaaagctgcgctctctaccagaccttaggagactacaaattacaaaatctgttccttattggttacacgaggaaagcccctcagctgacctcagcagagctgatcgacctcaccgggaagatggtgagcattgcctccacgtgctgccagctcagcgaggagaaatggtccggctgtggtgagggaatggccgacattttcattggacatttgtgtataaggaatgaagcaagccctgtgaactctggtatcagccactgctgcaactcttcgtattccaacaggaggctatgcatcaccagttttctgagggatgaaacctatgcccctcccccattctctgaggataaattcatcttccacaaggatctgtgccaagctcagggcaaagccctacagaccatgaaacaagagcttctcattaacctggtgaagcaaaagcctgaactgacagaggagcagctggcggctgtcactgcagatttctcgggccttttggagaagtgctgcaaagcccaggaccaggaagtctgtttcacagaagagggtccaaagttgatttccaaaactcgtgatgctttgggcgtttaaacatctccagaaggaagagtggacaaaaaaatgtgttgactctttggtgtgagccttttggcttaactgtaactgctagtactttaaccacatggtgaagatgtccatgtgagatttctataccttaggaataaaaacttttcaactatttctcttctcctagtctgctttttttttattaaaaaatacttttttccattc

SEQ ID NO: 3 - DNA, 4382 bp, Mus musculus
ctctgcaaggactggcgctgctagggacctgctagggacctcggagtcatggaccccattcagctgctcttctacgtgaatggccagaaggtggtagaaaaaaatgtcgatcctgaaatgatgcttttaccatacctgaggaagaatctccgactcacaggaactaagtatggctgtggaggcgggggctgtggggcctgcacagtgatgatctcgcggtacaaccccagcaccaaggcgatcaggcatcatcctgtcaatgcctgtctgacccccatctgctctctacatggtacagcagtcaccacggtagaaggcttaggcaacaccaggaccaggcttcatcctattcaggagagaattgccaagtgtcacggcacccagtgtggattctgtactcctgggatggtgatgtccatgtacgcactgctcaggaaccatccagagcccactctagatcagttaactgatgcccttggtgggaatctgtgccgctgcactggatataggcccataattgatgcctgcaagactttctgtaaagcctctggctgctgtcaaagtaaagaaaatggggtgtgctgtttggatcaagaaataaatggattggcagaatcccaggaagaagataagacaagtccagaactgttctcagaagaggaatttctgccactggacccgacccaagagctgatatttcctcccgagctaatgagaatagctgagaaacagccaccaaagaccagagtgttttatggtgagagggtgacatggatttcccccgtgactctgaaggaacttgtggaagctaaattcaagtatccccaggcccctattgtcatggggtacacttctgtgggacctgaagtaaagtttaaaggtgtcttccaccccatcataatttctcctgacagaattgaagagctgggtgtcataagccaggccagggatgggctgaccctgggtgctggcctcagcctggatcaggtgaaggacattctggctgatatagtccagaagcttccagaagagaagacacagacataccgtgctctcctgaagcacctgagaactctggctggctcccagatcaggaacatggcttctctagggggccacattgtgagcagacatctggactcagatctgaatccccttctggctgtgggtaactgtaccctcaacttactgtccaaagatggagaacggcggatccctttaagtgaagagtttctccgaaagtgtcctgaagcagatcttaagcctcaggaagtcttggtctcagtgaacatcccctggtccaggaagtgggagtttgtgtcagccttccgtcaagcgcaaagacaacagaatgcactagcaatagtcaactccggaatgagagtcctttttagagaaggaggtggcgtcattgaagagttatccattttgtatggaggtgtcggttcaactatcatcagtgccaagaactcctgtcagagactcattgggaggccctggaatgaagggatgctggacacagcctgtaggctggttttggatgaagtcacccttgcagcctcagctcctggtgggaaggtggagttcaagaggaccctcatcatcagcttccttttcaagttctacctggaggtgtcacagggtttgaagagggaggacccaggtcactctcctagcctggcaggcaaccatgagagtgctttagatgatcttcattcaaaacatccctggagaacattaacccaccagaatgtagatccagcacagctgcctcaggaccccattggacgtcccatcatgcacctttctgggattaaacatgccacgggcgaggccatctactgtgacgacatgcctgcagtagaccgggagcttttcctcacttttgtaacaagttcaagagcacacgctaagattgtgtccattgatctgtcggaagctctcagcctgcctggtgtggtggacatcattactgcagatcatcttcaggaagcaaacaccttcggcacagagacatttctggccacagatgaggtacactgcgtgggccatcttgtctgtgctgtgattgcagattctgagacacgggcaaagcaagcggcgaagcaagtgaaggtggtctaccaagacttggcgcctctgatcctaacgattgaggaagctatacaacacaagtccttcttcaagtcagaacggaagctggagtgtgggaatgttgacgaagcatttaaaatcgttgatcaaattcttgaaggtgaaatacacataggcggccaggaacatttttatatggaaacccaaagcatgcttgttgttcccaaaggagaggatggagagattgacatctatgtgtctacacagtttcccaaatatatacaggatatagtcgctgcaaccttgaagctctcagccaacaaggtcatgtgtcatgtaaggcgtgttggcggggcatttggagggaaggtgggcaagaccagcatcttggcagccatcactgcatttgctgctagcaaacacggtcgcgcagtccgctgcattctggaacgaggagaagacatgttaataactggaggccgccatccttaccttggaaagtataaagctggattcatgaatgacggcagaatcttggccctggacgtggagcactactgcaatggagggtgctccctggatgagtcactatgggtgatagaaatggggcttctgaagctggacaacgcttacaagtttcccaacctacgctgccggggctgggcctgcagaaccaaccttccatccaacactgctctgcgtgggtttggctttcctcaggcagggctggtcaccgaagcctgtatcacagaagtggcaatcaaatgtggcctgtcccctgagcaggttcgaaccataaatatgtacaagcacgttgatactacccattacaagcaagagttcagcgccaaggccctctctgagtgctggagagagtgcatggccaagtgttcctactttgagaggaaagcagccataggaaaattcaacgcagagaattcctggaagaagagaggaatggctgtgattcccctgaagtttcctgtgggtattggatcagtagccatgggacaggcagctgccttggttcatatttatttggatggctctgcactggtctctcatggtggaattgagatggggcagggtgtgcacactaaaatgattcaggtggtcagccgggaactaaggatgccgatgtccagtgtccacctgcgtgggacaagcacagaaaccgtccccaacacaaatgcctctggaggctctgtggtggcagatctcaatggactggcagtaaaggatgcctgtcagacccttctaaaacgccttgaacccatcatcagcaagaatcctcagggaacttggaaggattgggcccagactgcttttgaccaaagcatcagtctctcggctgttggatatttcaggggttatgagtcgaatatagactgggagaaaggggaaggtcatcccttcgaatactttgtgtttggagctgcctgctcagaggttgaaatagactgcctgactggggaccataagaatatcagaacaaacatcgtgatggatgttggccacagcataaacccagcccttgacataggtcaggttgaaggtgcatttattcaaggaatgggactttacacaatagaggagctgagttactctcctcagggcactctatacagtcgtggtccaaaccaatacaagattcctgccatctgtgacatccccacggaaatgcacatttcttttttgcccccatctgaacactcaaacaccctgtattcatctaagggcctgggagagtctggggtgtttctgggatgttcggtattttttgccatccatgatgcagtgaaggcagcgcggcaggagagaggcatctctggaccatggaaactcaacagtcctctgactccagagaaaatcagaatggcctgtgaagataagttcaccaaaatgatcccaagagatgagcctggatcctatgttccctggaacatacctgtgtgagtcaaacatgaacctctggaggaattggctgagcaactacagaccgtacctcctgcctgctctgctctaagatgctaaatgcgaaagccagagtttcacagcccagaatcatctacagcactgctttacatgaagccgactcggaagattctcttgaggatactccagatacacctgagcaattataaatcatatattaaattgcacaaatatttaaatcgtttgctctaaggtggtttcaatcattattctgtcccttggatccgtcaagctaactggactatatgacacctgagcaattataaatcatatattaaattgcacaaatattt

SEQ ID NO: 4 - DNA, 748 bp, Mus musculus
ctaagcttcattggctctagattcctggctttccccatcatgttctccaaagcatctgaagctatggcttgcaattgtcagttgatgcaggatacaccactcctcaagtttccatgtccaaggctcattcttctctttgtgctgctgattcgtctttcacaagtgtcttcagatgttgatgaacaactgtccaagtcagtgaaagataaggtattgctgccttgccgttacaactctcctcatgaagatgagtctgaagaccgaatctactggcaaaaacatgacaaagtggtgctgtctgtcattgctgggaaactaaaagtgtggcccgagtataagaaccggactttatatgacaacactacctactctcttatcatcctgggcctggtcctttcagaccggggcacatacagctgtgtcgttcaaaagaaggaaagaggaacgtatgaagttaaacacttggctttagtaaagttgtccatcaaagccccagaagaccctcctgatagcaagaacacacttgtgctctttggggcaggattcggcgcagtaataacagtcgtcgtcatcgttgtcatcatcaaatgcttctgtaagcacagaagctgtttcagaagaaatgaggcgagcagagaaacaaacaacagccttaccttcgggcctgaagaagcattagctgaacagaccgtcttcctttagttcttctctgcccatgtgggatacatggtattatgtggctcgagag

SEQ ID NO: 5 - DNA, 2681 bp, Mus musculus
tgtccccagtgacctgcttcctctaatctgacccatttcctacttttcaccatctccagcaatgccaccacagtgggactatgacaaactcctcagactcctgtggcttctcacaagcctgaccgtccactggtaaccaagcctttaacataagagcctttgggagagcgttacatctagactatagtcatcatacaggcgaaaaacgaacgaaccaataatcaaattagatgaccaccactgcctctgcctatctgtatatttgccggagcaacattcctttcctatttccatttaaacatatcactccttggaatgccttcccacaatgctcctccctttcagttctgtgatgaagtttccccaacttacacccagctgtattctggccaatctgctgtacttgagaaccaagtcacaagtccaactttctccgcatgccttttgtgccatcttgctgagatcatgtagctccatctaccgactttagtacgttacatactacttgggtttattttcctgtagccttttccagactacaagctcgtagagaaaagcaaccatgtcggagatctttaccacgcacacagtagacgataatcttctagactaaacgacacgtggttgcttggtgtacctggtacttaataaacatttgcttggtgaatagctactgcatttcatattataaaaattgcctattttaatattctttagttatcgagattaatatctattgttacctcaagttaaatataattgacctcgaaattttaagcatagtatttttctctcttgcaaaaattagagttgcaacattcatttcttccttttgtttcctcaggtctcatctaccatttgcaactgacctcttctgcaaaggacttcagaaacctagcactaccctggctctgcaaacacggttctctaggtgaagcctctgcagtggtttgcagaagtactcagacgaatgaaccacagtagttctgctgattctgaggacgtagtttagagactgaattctttggaaaggacatagggacgatttgcacatttgcttgcacatcacacacacacacacacacacacacacacacacccacacacacacactctctctcgataccttaggatagggttctaccctgttgctcagtgacaaagaatcactctgtggcggaggcaggcttcaagcttgcagcaatcctcctgcaccagtttcctgagtgccagacttccaggtgtaagctatggcacttagcagaacactagctgaatcaatgaagacactgaggttccaagagggaacctgaattatgaaggtgagtcagaatccagatttcctggctctaccactcttaacctgtatctgttagaccccaagctctgagctcatagacaagctaatttaaaatgcttttaataagcagaaggctcagttagtacggggttcaggatactgcttactggcaatatttgactagcctctattttgtttgttttttaaggcctactgactgtagtgtaatttgtaggaaacatgttgctatgtatacccatttgagggtaataaaaatgttggtaattttcagccagcactttccaggtatttccctttttatccttcatgtccttaaaagaaaccagagtcaaccagaattaactgcttttgttgtctaagatgaatgtatgccttttatacttcaaagcaaaagtcaagttggaggcacagttcgtaacttactcgttcatattgaacttataatgaatgtctttaggcaactttgcccttttacacagttcttgatatagttcttatttcaaatgagattatttactgagtaatcatctgtcctcacataaacaacttaagtgatactagccttacacagaacttcctcagattcctggaagtggcttttgctctttggtatagatctgctacagtggaattgaaaaataaaatgtacgttagacacacttgcctgtaatccctgcactcagtatactgaggctgaagaactgaattccaggtagcatggcctggatagtaagatcctgtctgaaacccactcctccatcaatgtgccccaaagaaatggaaaacaagaagcagctaactgctgcttctatactgaaggttcccttttctctgagatgtaatccacaacctacaagaccagcagtgagcttaagtcaagacaatcagatattctagtctgaatttataggaggacatcgaatggcagccaaacttctcaacgggaccagaatctgttgtatgcccaggaaacaggtccatttttatgtgggtgctctcagaaccaagccactaaagaaaacaaagtggtggactgacaaaaagctaacaagacattgaaagccacaccaaagaaaaaccaggagggcgggggaagtaagctgcagcatttaatcagtggtgatcgggctcaccacgagacttcaaaaacagttagtgacaaaaaggatcaatcaaagggaaacttagaaaagtaagttatgttaaattattgattacatttgataagcgttagttgttttttttaagatttatactttttattattcaggtgttttcttttgctaaagtaatttttaaaaactgtttagttttataatttttaaagatttttgcctatgttattataaataaaacaatg

SEQ ID NO: 6 - DNA, 1909 bp, Mus musculus
gagccgagaggtgtgagccgccgcggtgtcagagtctaggggaattggagtcaggcgcagatccacagcgatatccagacattcagagccacaggcaccatgtccaatcctggtgatgtccgacctgttccgcacaggagcaaagtgtgccgttgtctcttcggtcccgtggacagtgagcagttgcgccgtgattgcgatgcgctcatggcgggctgtctccaggaggcccgagaacggtggaactttgacttcgtcacggagacgccgctggagggcaacttcgtctgggagcgcgttcggagcctagggctgcccaaggtctacctgagccctgggtcccgcagccgtgacgacctgggaggggacaagaggcccagtacttcctctgccctgctgcaggggccagctccggaggaccacgtggccttgtcgctgtcttgcactctggtgtctgagcggcctgaagattccccgggtgggcccggaacatctcagggccgaaaacggaggcagaccagcctgacagatttctatcactccaagcgcagattggtcttctgcaagagaaaaccctgaagtgcccacgggagccccgccctcttctgctgtgggtcaggaggcctcttccccatcttcggccttagccctcactctgtgtgtcttaattattatttgtgttttaatttaaacgtctcctgtatatacgctgcctgccctctcccagtctccaaacttaaagttatttaaaaaaagaacaaaacaaaacaaaaaaaaaccaaaacaaaacaaacctaaattagtaggacggtagggcccttagtgtgggggatttctattatgtagattattattatttaagcccctcccaacccaagctctgtgtttcctataccggaggaacagtcctactgatatcaacccatctgcatccgtttcacccaacccccctccccccattccctgcctggttccttgccacttcttacctgggggtgatcctcagacctgaatagcactttggaaaaatgagtaggactttggggtctccttgtcacctctaaggccagctaggatgacagtgaagcagtcacagcctagaacagggatggcagttaggactcaaccgtaatatcccgactcttgacattgctcagacctgtgaagacaggaatggtccccactctggatcccctttgccactcctggggagcccacctctcctgtgggtctctgccagctgcccctctattttggagggttaatctggtgatctgctgctcttttcccccaccccatacttccccttctgcaggtcggcaggaggcatatctaggcacttgccccacagctcagtggactggaagggaatgtatatgcagggtacactaagtgggattccctggtcttaccttaggcagctccagtggcaaccccctgcattgtgggtctagggtgggtccttggtggtgagacaggcctcccagagcattctatggtgtgtggtggtgggggtgggcttatctgggatggggaccccagttggggttctcagtgacttctcccatttcttagtagcagttgtacaaggagccaggccaagatggtgtcttgggggctaagggagctcacaggacactgagcaatggctgatcctttctcagtgttgaataccgtgggtgtcaaagcacttagtgggtctgactccagccccaaacatccctgtttctgtaacatcctggtctggactgtctacccttagcccgcaccccaagaacatgtattgtggctccctccctgtctccactcagattgtaagcgtctcacgagaagggacagcaccctgcattgtcccgagtcctcacacccgaccccaaagctggtgctcaataaatacttctcgatgatt

SEQ ID NO: 7 - DNA, 1669 bp, Mus musculus
cgcttccccggtgctcaccacccgcgtcaccaggaggagcgcactggagccaagccgcagaccggactccagattccaaggaggccacgccatgaagattctcctgctgtgcgtggcactgctgctgatctgggacaatggcatggtcctgggagagcaggaggtctctgacaatgagctccaagaactgtccactcaagggagtaggtatattaataaggagattcagaacgccgtccagggagtgaagcacataaaaactctcatagaaaaaaccaacgcagagcgcaagtccttgctcaacagtttagaggaagccaagaagaagaaagaggatgctctggaggacactagggattctgaaatgaagctgaaggcattcccggaagtgtgtaacgagaccatgatggccctctgggaggagtgcaagccctgcctgaagcatacctgcatgaagttctatgcacgtgtctgcaggagcggctcagggctggtcggccagcagctagaggagtttctaaaccagagctcacccttctacttctggatgaacggcgaccgcatcgactccctgctggagagtgaccggcagcagagccaagtcctggatgccatgcaggacagctttgctcgggcatctggcatcatagacacgctctttcaggaccggttcttcgcccgtgagcttcatgacccccactacttctcccccatcggcttcccacacaagaggcctcatttcttatatcccaagtcccgcttggtccgcagcctcatgtctccctcccactatgggcctccgagcttccacaacatgttccagcctttctttgagatgatccaccaggctcaacaggccatggatgtccagctccacagcccagccttccagttcccagacgttgatttcttaagagaaggtgaagatgaccgcactgtgtgcaaggagatccgccgcaactccacaggatgcctgaagatgaagggccagtgtgaaaagtgccaggagatcttgtctgtggactgttcaaccaacaatcctgcccaggctaacctgcgccaggagctgaacgactcgctccaggtggccgagacggtgacagagcagtacaaggagctgctgcagtccttccagtcgaacatgctcaacacctcatccctgctggagcagctgaacgaccagttcaactgggtgtcccagctggctaacctcacacagggcgaagacaagtactaccttcgggtctccaccgtgaccacccattcctctgactcagaggtcccctcccgtgtcactgaggtggtggtgaagctgtttgactctgaccccatcacagtggtgttaccagaagaagtctctaaggataaccctaagtttatggacacagtggcggagaaggcgctacaggaataccgcaggaaaagccgtgcggaatgagatagaagcatcaccttcctatatgtaggagtgtctgggagggaatctcccagctccccgaggtggctgcagacccctagagaactccacatgtctccaggcgagtaggcctcacccaagcagcctgcccttcctctggattctgtacactaatgcctgcacttgctgctctcgggaagaactgattcccccacgcaactaatccaataaaagccgccttgcgatacgtgt

SEQ ID NO: 8 - DNA, 725 bp, Mus musculus
  modified_base (687)..(687): a, c, g, t, unknown or other
  modified_base (712)..(712): a, c, g, t, unknown or other
ttttttttttttttttttacagcattggatttgcatttatttgtggcactaagagaaagagcagacagctgtgactaagagcaattggctggtagctcttgcctcactgagaaagtttagcaatgttaatcacacaataccaagttcccactctacccgatgcctagatttaaaacagggggaaatagtaaaaggatttcatttttttttcagtaaggcagagattttatatcatgaactcattttgacttatattgctgtcttgattttctccatataagaaaaggttttagagatacattaaaaaaaatcacaaaacttcctgctgagtttaaattctttaaagatggtgtctacccacaatgtactataagaatgtcatataataccagggcagctgctggaccatgccaaagtgtgtcaggataaaatgtaagccacagaatgtgcagcacaatgtggactgccctctgctacatataggtcctcaacactctgctctctggccctgtgcaggatttcagaaggctactggtgaaatctcaggctccatgcaaggctccttcacagtaacctgatgcatgtcatagccttctgggacactggggatgggggaggggggaaactatacaagtgggacacatctatacagaaaacggacaacccttccagtgttctcatctctgncttccatcatcttctaagggagcangaatgtcttgctc

SEQ ID NO: 9 - DNA, 419 bp, Mus musculus
gagatatggcctctaaacccaaagagtcacacgctttctttaccagagagttcacagggttagaaccaattgtctctgacgtcatcagaggcatttgtagagacttcttagaatcccagcaataaccgatactctgacaactcaaggaatacgtgcaaggggatctaatgtgcaaattatattctcaatgcctatgtaactttatagcttaccagtgtcaaaaaatgcgtccacagctgtttaaagcaaatgaatattcatgtgatgctcacaatttagattggccgagacttgataatcaggcccttagaaactcaggaaagaagagttgtcatggattaacattgggagttcaaatatgcattcaagtggataggtaagctacacagctcaataaaagaacctggcgcttacacacg

SEQ ID NO: 10 - DNA, 4964 bp, Mus musculus
agcctgattttgtacgcctgcccgttaggacttcccaccataattagtgcttcttgcccctgagaggaggagcttcggctcaggggaacttcatgcaataagggaagaaaacagtataaatactccagggcagccgtggggaaggcattatccactgctcctgggcagaggaagccaggaaagctgccccacgcatctcccagcaccagtgatttttaaaattgactttctaccaaaaggtacccagacaggttcatttgtattgatctatttaagacattcttaacgaaaatgactgtacaaacttgccttaatgtaaatttcaatttatctcgaaagttctagctatttcaagtcatgtcaaagactctggattatttaatatagtcatctagtaatgaggctatttaatatagtcatctagtaatgaggctatttggtgggggtcattttatttttagagcattatttcaaggcagtttccaaacactagtaagacatatatactcatacaacaaaaactttcctcctataattttatagaatatattctaagtataaaaggtcagtcatttaaaaaaccatgagataactacataaataatcagtctgtagaacatcgtagaaatgaaacagatcagtgatgggctatgtgtaatgattctcttctgcttttcagaatctatctgaaaatatgctgcctcaaataccctttctgctgctaatgttcttgaccctggttcatgggatgttttatgctgaacggtaccaaacgcccacaggcataaagggcccacttgctagccccaagacacaatacttcatcccatacgccataaagagtaaagggattccagtaagaggagaacaaggcattcctggtccaccaggcccaaccggacctcgaggacacccaggtccctcaggaccgccaggcaagccaggctatggaagtcctggactccaaggagagccagggttgccaggaccaccaggaatatcagccacggggaagccaggcctgccaggcccgccaggcaaaccaggggagagaggaccatatggacacaaaggagatattggcccagctggcttacccggacctcggggccctccagggccccctggaattcctggcccagctggaatttctgtgccaggaaaacctggacagcagggacttacaggtgccccaggacctaggggctttcctggagagaagggtgcacaaggagcccctggtgtgaatgggcggaaaggggaaacaggatatggctctcctggccgtccaggtgagaggggtcttccaggccctcaaggtcccataggaccccctggcccctctggagtgggaagaagaggtgaaaacggctttccaggacagccgggcatcaaaggtgaccggggtttcccaggagaaatgggaccatcaggtccaccaggtccccaaggtcctcccgggaagcaaggacgagaaggtattgggaagccaggagccattggatcccctggtcagccaggtattccaggagaaaaaggccacccaggggctccaggaatagctggtcctccaggagctcctggctttggaaaacaaggcttgccaggtttgaggggacaaaggggacctgctggtcttcctggggctccaggtgccaaaggggaacgagggccagcaggtcatcctggagaaccgggtctgcctggatcccctgggaatatgggaccccaaggacctaaaggaatcccagggaaccatggcattccaggcgctaaaggtgagataggtctagttgggcctgcaggcccccctggggctagaggagcaaggggtccacctgggttagatggaaaaacagggtatcctggggagccaggtctcaatggtcctaagggtaacccagggttaccaggacaaaaaggtgatcctggagtgggaggaacccctggtcttcgaggtcctgttggccctgtaggagctaaaggagtgcctggacacaatggtgaggcaggtccaagaggtgaacctggaataccaggtaccaggggccccactgggccaccaggtgtcccaggattccctggatctaagggtgaccctggaaacccaggtgctccaggcccagctggcatagcaactaagggcctcaatgggcccactggtcctccaggccctcctggtccaagaggccacagtggagaacctggtctcccaggtcctccgggtcccccaggaccccccggccaagcagtcatgcctgatggcttcataaaggcaggccagaggcccaggctttctgggatgccgcttgtcagtgctaaccacggggtaacaggtatgcccgtgtctgcttttactgtcattctctctaaagcttacccagcagtaggtgcccccatcccatttgatgagattctgtacaataggcagcagcattacgacccaagatctggtatctttacctgtaagatcccaggcatatactatttctcctaccacgtgcatgtgaaagggactcacgtttgggtaggcctgtataagaacggcacgcctacgatgtacacgtatgatgagtacagcaaaggctacctggatcaggcttcagggagtgcaatcatggagctcacagaaaatgaccaggtatggctccaattgcccaatgcagaatcaaacggcctctactcctctgagtacgtccactcgtccttctcaggattcctagtggctcccatgtgagcacttcctgtcaagctcatcctattctccgcttagaaaggctttccacccaattccatcgcgccctccctggagatgcatttggaggtaggctaaaagtaatgtgaacaacttacactttctaaagtgcactctgggaccaagtttcctcacttctaaagtgaacagtaacagtgggtatgtgaggatcctcccgggagcactcagcaatcctaaagccctggggggtggtgagggggtggtgtctgttattccatcaatacttacatttttttaacagaagctttaaaaaaaagcctcacaaaaacagaaataagactctaactcaccataaatctcatttcaaaaactcaacattctcctttcaaaaaagtccatttttaataatatgaaaacatctaggaaacatgcaggaattatcatgcaactttatattctttaaatacttgaatatcaaattgaaatgacactgtatacctaggatatttctgatggtgcatcactcaatggctcatacaacccctttcatcaagataaattcaaatgcacaggtacacacatggtttttgaagtgcgcataagaaaccaaaatactgtattaaaattaatttcgattataaggtgctttgtcacagctgtttcaagcttttctgcaattgcagaaagtccacatacctggtgtaacttggaaacaagtgtctgacttatgtcagtaacacagtgcacagtgtgattactctgatttaattccttgcatctttgtaaaatgattttatgggcttatacaatattagaatagacactttgtgtgcctttcaatcgagtggaagaataaacattaagggtttgaacatcagactagaaacgaaaagacattatttatttatgctctgtactgtatttttacattattgtttaaaactggtaggctgtacctcacttattaaagcccggagtatttaatctacttggtattacgaagcaataaaatgacatgaatagacctttattctgtgctgagttctttcatagtgacaacaggctgttcacagctttacagcttcgcactggctgaagctaataagaaaagcagtgaagcggggtgactctacagttgtcatgggcttgtctctctgtcatggtgggaaggcacatgccaaggggttctgcaaggatgtaaaaaaacagcctctatgagcctggaccaaagctgatgagtagacacagggaaataaaaatatataaatatcacttcaaaactctggtttgtcttagagggagggaagacggtatcacacaaatatcaaattggaaccaatatcctgcaattattatttattgccttagcacattttagtcataatattaaattattttggtggcttgatttactgaaaaggagggatggattgtgtgtgtgtgtgtgtgtgtgtgtcaatcaaaaggcaacatatttcaaaacttaaaatcctgctgattagcatcgatcagcccacttgttaatcaagcctgtctgactcaatcactagggcagcgtaatatacaggctattcactccctgaaataagattctctgtaaccctgcagcaaaggaaaactcaaagtgctaccttgtgggtggcagtaactctgctctcattctgggccaaccactcctgttccgtatacaatgagatagaatggaggcaggcactttatatgtcctccaccactaccacactgagggtcacaggtgtcactagctcccactcctaagccagaaagcaaggactgggactttcagtctagaaaacgccctcctgcccaggagaactgcactaggagacttctggaagtagctggataaactggcttagactcctgacagctataaccacagaacagagataaatataggtatcaggactaattttagagcaaacatttttaccagattaaataccaagtaagaaacaaaagaggtagactctacctaattcagtagacacgggcagttaacaaacctctaccaggaggcctctcttcaatgttactcacccttaaaggctgacatttaaaattgtgttgtataccagcaactacatccttccaaaaatcaaatgttttttgacctctgttctgctaaaaaaagaaatttccaaatgtaacaagtgcagtaattctgcttctaaacatagtggtaagctacagcaaatcgttacatgtatctactttaaggtaagaattc

SEQ ID NO: 11 - DNA, 4353 bp, Mus musculus
gctcgtccgtgcccgctgccggggccgtgctcgttaagcacgcgggacctcgtggtctgcggttctcggggcgcgatcatttgtgcagccatcactttcttcaccgagtccaagtgccacggtagagcctgcttcctcaggtcccctcggtggcgcaagaatccccgcacctagacggaggcgtggccaccagaagccccgccccgtctgtgacgtcctggtggcgcgcgagctgtctgtgggcgtgtgaagggcccgggccagactaagccatcaggccggggccgcctcccgacttctatctgccggcttctcctgctccatcttttccgagaagcggtgtgcgacctcggcccccagcctaccgggcggatcgaagcgacggtcgggatggtacttctgggcttgctgcagtcaggcggctgggtgctcggacaggcgatggagcaggtgacaggaggcaacttgctttccacgctgctcatcgcctgcgccttcactctcagcctcgtctacctgttccgtctcgccgtgggccacatggtccagctgcccgctggagcgaaaagtccaccacatatttactctccaattccattccttggccatgcaatagcatttgggaaaagtccaattgagtttctggaaaatgcatatgagaagtatggacctgtgtttagctttaccatggtgggcaagaccttcacttaccttctggggagtgatgcagctgcgctgctcttcaatagtaaaaacgaagacctgaatgcagaagaagtctacggtcggctgacaacacctgtgtttgggaagggagttgcatatgatgtgccaaatgcaattttcttggaacagaagaaaatcataaaaagtggccttaacatagcccactttaagcagtatgttcctatcattgaaaaagaagcaaaggaatactttcaaagttggggagaaagcggagaaagaaatgtgtttgaagcactgtctgagctcataattttgacagctagccattgtttacatggaaaggaaattagaagtcaactcaacgagaaggtggctcagctgtacgcagacctggatggaggttttacccacgctgcctggctattgccagcttggctgcctctgccaagtttcaggcgcagggatagagcccatcgagagatcaagaatattttctataaggccatccagaagcgcaggctgtcaaaagaaccagctgaggacattcttcaaactttactagattctacatacaaggacgggcgtcctctaacagatgaggagatatcagggatgctcatcggactgctgctggctggacagcacacatcctccaccaccagtgcctggatgggcttctttctggccaaagataaaccacttcaagaaaaatgctacttagaacagaaagcagtgtgtggcgaggatctgcctcctttaacttacgaccagttgaaggatctgaatttacttgatagatgcataaaagaaacactaagactgaggcctccaataatgaccatgatgagaatggccaagacccctcagacggtggcagggtacaccattcctccaggacatcaggtgtgtgtctctcctactgtcaatcaaagactgaaagactcctgggcagagcgcttggactttaatcctgaccgctacttacaggataacccagcatcaggagagaagtttgcctatgtgccatttggagctgggcgtcatcgttgtgttggagaaaattttgcctatgttcaaattaagacaatttggtcgactatgcttcgtttatatgaatttgacctcatcaatggatattttcccactgtgaattatacaacaatgatccacaccccagaaaacccagtaatccgttacaaacgacgatcaaaatgagaagaggaacaagaagccagtgtggagagaggaccgcaagccgcagctggcaaagaatgaagcctctgagaagctctcgtgctgtactgggttgaagagtgtggttctgagagccagtttatgattttaatgttttattaactcggtgatttttgtcagaccgaatggcatttgaaacagtttatagtagttttgataggatttcagggaagccaagtttatgttagaaatcatttgggggggtgtgtcttggaattaagaagatatagaatgcagcatccaggtaattaactccacacattgccacagggagatttggaactggtgtttgaagtttcaaagccttgtcaaatgctacaaaggtaatggggtcgtgtagttgggccacttctgtgcgtaaagatatgaaaggataaaggttaagtttactgcgaagcttgaggtggaagtaaacgctacttagatggtgtggtgtgtcctttgaaatgttaactggagcaccgctcctggaagatggcagcgatcttgaaccttgccttgataaccttaattcctaaaagtaataaaatctaaagagtgcttatgtatgttactggtcccaaatggtcacagttttgtgaaaaatccaaaatcaaatccttgtaagacttttttattttaatttggcttaaggttttttgttgttgttgggaagtttaaatttaccaggcttttaaaagtgtctgattttgagattagtgagttctggccttgagactggggaatgggagatggtatcattgcccgtattctgtgctcaggagacaacctaacagattgtaaccacggacccaactctgtgacatgcccttaatctgtgttaggagtaagaatagctctgttgctggagtggtgctgcacacctgtaatgctgttattcaggacctgcggcaggattgagaatttgaggccaacctaggctacggagcaagactaacacactccccaaaataaaacctcttttctctaaaagtatgtgtactggctggtcttaggcacttgacacaagctagggtcatcagagagaaaaggaagcctcagttgaggaaatgcctccatgagatccagctgtaaggcattttcttaataagtgatcaatgggagaggctccagcccactgtggtggttccatccctacgctagtgatcctatgaaaggctgaccgtgacatgaggagcaaaacagtaagcagcactcatttatggcctctgcatcagctcctgcctccaggttcctgacctgcttgagttcctgtcctcacttgatgataaacagtgatatggaagtgtaagccaaataacccaccttcaccctcgggatttgctttttggtcatggtgtttccttgtagcaagaggaactgaaactccgttacagttttaagaggcttttgaagactcccagtgaaggcctaaatctctgctgttaaaggctccacattaaaattctctgagaaagttttactggtttgtattcatgaatttgaacttgtgcttcagtaagtacagttcatgaaatctgggcatatggaagcttacatcctatttgcctgaaataggttccttttagtattatctttggttatttaggtaagtcactcttgttatcaatgccccatgagaaatcaggtattttcataacaagttacaaaagttgctcacctctcaaaagtgtgcttgtctcttactgagtggttgttagacttttaggtcatagatgttacatttgacgtgttaggttaaaaccttgattaaagtttgaagactgtttgtttctaagtaacagattttctttgccagtgtagatgttttgtgtttattattcctagaggggttctagactttgatcaagtccctccttttactgtgtggttgttaagacttttaagtcatagacgtgttaggttaaaaccttgattaaagtttgatgattgtttctaagtaacagattttctttgccaatgtagatgttttgtctttattattcctagaggggttctagactttgatcagattggtagattcctggcagagttgtgacttgagtaaggctgtcctgtttactgtctagttttagactttgacatattttcagtgctgagatttaaaagggctcaagcactagaattccagattgagatactgaccacagacgagctattaagttattgtgaacaacacagcagaggctgagggccatagggtgttagtagggtagactagcagtagggtagattggctggcaagcacctgtccatctgccttttcccgactgaactgtcttgacttggcaactgtattagttttttaaagagtttaatgcacaactttcctgctcaactagttgctttagaatagttttgatatttttagaaagcctagttgaaatttgggaaataaaattagaaattccc

SEQ ID NO: 12 - DNA, 622 bp, Mus musculus
aaatgggttgtttggtttttttagtacccgtgttttttagggagttgggtgttacttccagccctgctgggattggatgattttttaaaattttattttattttattttacttctctggacacagttgagagttttttgctaggtataatctaagaaggaaagcacccaggaagaagggctccgggaggccatctagcagggcagcctgtgaacccagaactcatggtttcaagagctccactcctgacctccaaaccagtgtgggctgcaggctggctgctcccctcagccaaggatggcaagagagaaaagttccattttaaaaactggttaaaagtcctggaggcaggcgctccgaggaggcagccagaatggaaaaagatgctggaaggagcagaatttcctgagggggctgaggcggccctgtccatatgggacgtgtggaaaacttgagaaatgtagatgcaggctcggagcagagagctggctgtgctcttccggcaaatctctccctccttcccagctccacccctacccctgccctgggagggagccttggaccacctcaaaggcctggtaactgtgactcagccccaaatttctgtccaggctcagaagctt

SEQ ID NO: 13 - DNA, 2902 bp, Mus musculus
cgcatttcctgcctctctgggccgggctggatgagctgagctccctgccctgacagtcagacccctgccttcatctgtgtcccgtccccaggccaggaccgccgacagctgctgcccgaaagagcccagtgactctttcccaccacccagtcagctagagactcctgccctgctgtgagtctcgagcccacttctcctgacttctccgccgccacctcagaaggctggagcagggacgttgtcgctccggccgcctgctcccttcggatccccgcgcgaacccacgcaggccccggcgcccgcccgcagccttacctctggataccggataaggcccagcgcacagactcccgggtggacagcatggaccgtggcgtgctccctctgcccattaccctgctgtttgtcatctatagctttgtacccacaacaggtctcgcagaaagagtcggctgtgatctacagcctgtggaccccacaaggggtgaggtgacgtttaccaccagccaggtctccgagggctgtgtagctcaggctgccaatgctgtgcgtgaagtccacgttctcttcctggattttcccggaatgctgtcacatctggagctgactcttcaggcatccaagcaaaatggcaccgagacccgggaggtgttcctggtcctcgtttcgaacaaaaatgtcttcgtgaagttccaggccccggaaatcccgttgcacttggcctacgactccagcctggtcatcttccaaggacagccaagagtcaacatcacagtgctaccatcccttacctccaggaaacagatcctcgactgggcagccaccaagggcgccatcacctcgatagcagcactggatgacccccaaagcatcgtcctccagttgggccaagacccaaaggcaccattcttgtgcttgccagaagctcacaaggacatgggcgccacacttgaatggcaaccacgagcccagaccccagtccaaagctgtcgcttggaaggtgtgtctggccacaaggaggcctacatcctgaggatcctgccaggttctgaggccgggccccggacggtgaccgtaatgatggaactgagttgcacatctggggacgccattctcatcctgcatggtcctccatatgtctcctggttcatcgacatcaaccacagcatgcagatcttgaccacaggtgaatactccgtcaagatctttccaggaagcaaggtcaaaggcgtggagctcccagacacaccccaaggcctgatagcggaggcccgcaagctcaatgccagcattgtcacctcctttgtagagctccctctggtcagcaatgtctccctgagggcctccagctgcggtggtgtgttccagaccacccctgcacccgttgtgaccacacctcccaaggacacatgcagccccgtgctactcatgtccctgatccagccaaagtgtggcaatcaggtcatgactctggcactcaataaaaaacacgtgcagactctccagtgcaccatcacaggcctgactttctgggactccagctgccaggctgaagacactgacgaccatcttgtcctgagtagcgcctactccagctgcggcatgaaagtgacagcccatgtggtcagcaatgaggtgatcatcagtttcccgtcaggctcaccaccacttcggaaaaaggtacagtgcatcgacatggacagcctctccttccagctgggcctctacctcagcccgcacttcctccaggcatccaacaccatcgaactaggccagcaggccttcgtacaggtgagcgtgtctccattgacctctgaggtcacagtccagctagatagctgccatctggacttggggcccgaaggggacatggtggaactcatccagagccgaacagccaagggcagctgtgtgaccttgctgtctccaagccctgaaggtgacccacgcttcagcttcctcctccgggtctacatggtgcccacacccaccgctggcaccctcagttgcaacttagctctgcgccctagcaccttgtcccaggaagtctacaagacagtctccatgcgcctgaacgtcgtcagccctgacctgtctggtaaaggccttgtcctgccctctgtactgggtatcacctttggtgccttcctgattggggccctgctcacagctgcactctggtacatctattctcacacacgtggccccagcaagcgggagcccgtggtggcagtggctgccccggcctcctctgagagcagcagtaccaaccacagcatcgggagcacccagagcaccccctgctccaccagcagcatggcgtagtgcccagcctggagcctcggggagccccccagccagcccttgccctgcaggagagaccgagcagccacaagctggaaaccaccggccatgaacttgtcccaggaaccaaacacctcccctgcacctgttcattcctcccagtggagacttcagattggaataccttgggatctcctcaccccactttacagaactgcccaatccaggggctctgggatatggctgcccgggattacagaaagacacggcactgccggtcacacccatgctgcttagaagcctaagcctctgccttcaagctggatcctgtgcagggtgggcaggcaagaactcagacatgcccagcctagcccagggcggcctgcatctggccccagaagcctcctcacctggactggcacaacttcggttggggaaacagaagctgagggagcttagatggggtgggggatccaagcccctcccagcccacccattggccaggcagcaggggggagtggccaggcggctggttgtgggccaagtcctgcatattcactaataaatcagacatgaaaaaaaaaaaaaaaaaaaaaaa

SEQ ID NO: 14 - DNA, 3666 bp, Mus musculus
gagcgactccgatcgtgacaccggcccccgcacgattccccagggccccgcctagggagcagtccctgcttgcagccttgggtcctctcccagaatcccagagactctaagctgcgagcagacgcgggcccctgggaagcgaggtccccagaccagagaggacacgcgcgacgctaggaaagatctgcgaggtgcagatccaccgcgggggcctcggggggcgcagacctgcagagctggaggccggcgggaaggttggctgctggaggaacggtgcagagtaaatgaagagagcaaactggaataactcctaccagacaagaaggcaagcctggctgtagacaccaggtcttctgaaagccatagcagtgcctcagaacagggcagtggccgaggcaatggtgggagtgccgaagagaccgcatggctactgagggcacgactggctcagggagcagagtggtggcgggcatggtgtgcagtctgtggctcctggttctagggtcatcagttctagctctggaagaggtgctgctggataccacaggagagacctctgagattggctggctcacctacccgccaggtgggtgggatgaggtgagtgttctagatgaccagcgccgtctgactcggaccttcgaagcatgccacgttgcagggctccctcctggttctggccaggacaattggctgcagacacactttgtggaacggcgaggggcccagagggcacacatccgccttcacttctctgtacgagcctgttccagcctgggtgtgagtgggggtacctgccgagagaccttcaccctttactaccggcaggctgatgagccagacggccccgacagtattgcggcctggcacctcaaacgctggaccaaagtggacacaattgccgcagatgagagcttccctgcctcctcttcctcttcctcatgggctgtgggaccccacaggaccggtcagcgggtgggactgcagctgaatgtcaaagagcgcagctttggtcctctcactcagcgtggcttctatgtggccttccaggacacaggggcctgcctggcccttgtggcagtcaagctcttctcctacacctgtccctccgtcctgcgtgcctttgcctcttttcctgagacacaggccagtggagctggaggggcttccttagtggcagctgtgggcacctgtgtagctcatgcagaaccagaggaggatggagtaggaggccaggcagggggcagccccccaaggttacactgtaatggcgaaggcaggtggatggtagctgtgggaggctgccgctgccagcctggacaccagcctgctcgtggagacaagctctgccaagcctgccctgagggatcctataaggccctggctgggaatgttccctgttcaccgtgtccagcccgcagccactcccctgaccctgcagccccagtttgcccatgtctccaaggcttctacagggccagttcggacccaccagaggctccctgcactggtcctccatcggctccccgggagctatggtttgaggtgcaaggctcggcactcatgctgcactggcgtctgcctcaggagctgggtggacgaggggatctgctcttcaatgttgtgtgcaaggagtgtggaggtcacggagagcccagcagtggggggatgtgtcgccgctgcagggacgaggtgcatttcgacccccgccagaggggactgactgagagtcgagtgttagttggggggctccgagcacacgtgccatacatcttggaagtgcaggctgtcaatggggtgtctgagctcagccctgaccctccccaggcagcagccatcaatgtcagcaccagccacgaagtcccttctgcagtccctgtgatgcaccaggtgagccgggcagccaacagcatcacagtatcctggccacagcctgagcaaacaaatgggaacatcctcgactaccagctgcgctactatgaccaggcagaagatgaatcctactccttcaccatgaccagtgagaccaacactgccactgtgacacggttgagccctggccacatctatggcttccaggtgcgggcacggactgcagctggccacggcccctatgggggcaaagtctattttcagacattgcctcaaggtgagctgtcctcccagcttccagagaagctgtccttggtgattggttccatcctgggggccttggccttccttctactggcagccatcactgtactggctgtcatcttccagcggaagcgccgtgggaccggctacacagaacaactgcaacaatacagcagcccaggacttggagtgaagtattacattgacccttctacatacgatgacccctgccaggccatcagagagcttgctcgagaggttgaccctacatatatcaagattgaagaagtcattggggcaggttcctttggagaagtgcgtcggggccgactgcaaccccggggaaggagggaacaagctgtggctatccaggccttgtgggcagggggtgctgagagcctgaagatgacctttctgggtcgggcagcactgctgggccagttccagcaccccaatatcctgcggctggaaggtgtagtcactaagagtcggcctgtcatggtgctgacagaactcatggaacttggtcccctggacagctttcttaggcagcgagagggccagttcagtagcctgcagctggtggccatgcagcggggtgtggctgctgccatgcagtacttgtccagctttgcctttgttcaccgagcactctcggcccgaagtgtgctagtgaatagccacctggtgtgtaaggtggcacgtctcggccacagtcctcagggttcaagttccttgcttcgctgggcagccccagaggtcattacacatggaaagtatacaacatctagcgatgtctggagctttggcatactcatgtgggaagtgatgagctatggagaacggccctactgggacatgaacgagcaggaggtactaaatgcaatagagcaagagttccggctgcccccacctccagggtgcccccctggactacatctactgatgctagacacttggcagaaggaccgtgcccgtcggcctcattttgaccagctggtagctgcatttgacaagatgattcgcaagcctgatactctccaggctgaagggggctccggggacaggccttcccaggctcttctgaaccctgtggccttggacttcccttgcctggactctccccaggcctggctttcagccattggactagagtgctaccaggacaacttctccaagtttggtctttccaccttcagtgatgtggctcagctcagcctggaagacctgccaggcctgggcatcaccctagctggccaccagaagaaacttctgcacaacattcagctcctccagcagcacctgaggcagccaggctcagtggaagtgtaaagcctgctcaggagtctgtgagccgccgatgccccaacccagtcctggccatagggtggagaaggggcgtgtgagactgagtcaggctctactccagcttccatgcctgtcacattaaacccagccctctggacattgcacccccaaatcctgctcttccaacagcctcccccatattaaagggaaagaagggaattt

SEQ ID NO: 15 - DNA, 5555 bp, Mus musculus
ggctgtgggagagcagaagaggagctggaagagcagcctacaacagctgtcgggagggaccagggctagttcacacttggaagctgggatgccaggaccggccctcctgcctctctcggtctccatcggcctcctggtcagctcactccacactgagacgattctgaagtaagatgctcctggctcctcacagactctgctacaagagacagagtgaagtgtccccagggctcagagcctttgactctgctccttcccttcccacggctgagttggcacaggagcacctgggtgagctgcaccagacttaagaagatgaggcccctgattctgttagctgccctcctctggctccaggactctttggcccaggaagatgtatgctcatccttggatgggagcccagacaggcagggtggaggtccacctctgagtgtgaacgtcagcagccgcggaaagcctaccagcctgtttctgagctgggtagctgcagagccaggtggatttgactatgccctctgcctcagggctatgaacttgtcgggttttccagaagggcaacagctccaagctcataccaacgagtccagctttgagttccatggcctggtgccagggagtcgctaccagctggaactgactgtcctaagaccctgttggcagaatgtcacaattaccctcactgctcgaactgcccctacagtggtccgtggactgcaactgcatagcactgggagcccagccagcctggaagcctcatggagcgatgcctctggggatcaagacagctatcaacttctcctctaccacccggaatcccacactctggcatgtaatgtctctgtgtcccctgacaccctgtcttacaattttggtgacctcttgccaggtagtcagtatgtcttggaggttatcacctgggctggcagtctccatgcgaagactagcatcctccaatggacagagcctgtccctcctgatcacctaacactgcgtgccttgggtaccagtagcctgcaagccttctggaacagctctgaaggggccacctggtttcacctgatacttacagacctcctagagggtaccaacctgaccaaagtggtcagacaaggcatctcaacccacaccttccttcgcctgtctccgggtacaccttaccagctgaagatctgtgctgctgctgggccccaccagatttggggacccaatgccactgagtggacctatccctcttacccatctgacctggtgctgacccccttatggaatgagctctgggcaagctggaaggcagggcagggagcccgggatggctatgtactgaagttaagtgggccagtggagaatacaactactctgggtcctgaggagtgcaacgctgtcttcccagggcccctgcctccaggacactacactttggggctgagggttctagctggaccttatgatgcctgggtagagggcagtatctggctggctgaatctgctgctcgtcccatggaggtccctggtgccagactgtggctagaaggactggaagctactaagcaacctgggagacgggcgctgctctattctgttgatgccccaggcctcctagggaacatctctgtgtcttctggtgccactcatgtcaccttctgtggcttggtacccggagcgcactacagggtggacattgcctcatccatgggagacatcactcagagcctcacaggctacacaagtcccctgccaccacagtctctggagatcatcagccggaacagcccatctgacctgactatcggttgggctccagcaccagggcagatggaaggttataaggtcacctggcatcaggatggcagccagaggtcacctggcgaccttgttgacttgggccctgacatttcgagcctgactctgaaatctctggtacctggttcctgctacaccgtgtcagcatgggcctggtctgggaacctcagctctgactctcagaagattcacagttgcacccgtcccgctcctcccaccaacctgagcctgggctttgcccaccagcctgcaacactgagggcttcctggtgtcacccaccgggtggcagggatgcctttcagttacggctttacaggctgaggcccctgacactggaaagtgagaagatcctatcccaggaggcccagaacttctcctgggcccagctgcctgcaggctatgaattccaggtacagctgtctaccttgtgggggtcggaggagagcggcagtgccaacaccacaggctggacacccccctcagctcctacattggtaaatgtgaccagtgaagcccccacccagctccacgtatcctgggtccacgctgctggggaccggagcagctaccaagtgaccctataccaggagagcactcggacagccaccagcattgtggggcccaaggcagacagcacaagcttttggggtttgactcctggcactaagtacaaggtggaagccatctcctgggctgggcccctttacactgcagcagccaacgtttctgcttggacctacccactcacacccaatgagctgctcgcctctatgcaggcaggcagtgctgtggttaacctggcctggcccagtggtcccttggggcaagggacatgccatgcccaactctcagatgctggacacctttcatgggagcaaccgctgtcgctaggccaagacctcctcatgctaaggaatcttataccaggacatacggtttcattgtctgtgaagtgtcgggcaggaccactccaggcctccactcaccccctggtgctgtctgtagagcctggccctgtggaagatgtgttctgtcaacctgaggccacctacctgtccctgaactggacgatgcctactggagatgtggctgtctgtctggtggaggtagagcagctggtgccaggagggagcgctcattttgtcttccaggtcaacacctcggaggatgcacttctgctgcccaacttgacgcccaccacttcttaccgccttagcctcactgtgctgggtgggaatcgccagtggagccgggcggttaccctggtgtgcactacttctgctgaggtttggcaccccccagagctagctgaggccccccaggtggagctggggacagggatgggtgtgacagtcacacgtggcatgtttggtaaagatgacgggcagatccagtggtatggcataattgccaccatcaacatgacactggcccagccttcccaggaagccatcaaccacacatggtatgaccactactatagaggacatgactcctacctggctctcctgttcccaaaccccttctacccagagccttgggctgtgccaagatcctggacagtacctgtgggtacagaggactgtgacaacacccaggagatatgcaatgggcatctcaagccaggcttccagtataggttcagcattgcagcctttagtaggctcagctctccagagaccatcctggccttctccgccttctcagagcctcaggctagcatctctctggtggccatgcccctgacagttatgatggggactgtggtgggctgcatcatcattgtgtgtgcagtgctatgcttgttgtgccggcggcgcctgaagggaccaaggtcagagaagaatggcttttcccaggagttgatgccttacaacctgtggcggacccatcggcccatccccagccatagcttccggcagagctatgaggccaagagtgcacgtgcacaccaggccttcttccaggaatttgaggagctgaaggaggtgggcaaggaccagcccagactagaggctgagcatcctgccaacatcaccaagaaccggtacccacacgtgctaccttatgaccactccagggtcaggctgacccagctatcaggagagcctcattctgactacatcaatgccaacttcatcccaggctatagccacccacaggagatcattgccacccaggggcctctcaaaaagacggtcgaggacttctggcggttggtgtgggagcagcaagtccacgtgatcatcatgctaactgtgggcatggagaatgggcgggtactgtgtgagcactactggccagtcaactccacgcctgtcacccacggtcacatcaccacccacctcctggcagaggaatctgaggacgagtggaccaggagggaattccagctgcagcacggtgcagagcaaaaacagaggcgcgtgaagcagctgcagttcacgacctggccagaccacagtgtccccgaggctcccagctctctgctcgcttttgtggaactggtgcaggaggaggtgaaggcaactcagggcaaggggcccatcctggtgcattgcagtgcgggtgtgggcaggacaggcacctttgtggctctcttaccggctgttcgacaactagaggaagaacaggtggtcgatgtgttcaacactgtgtacatactccggctgcaccggcccctcatgatccagaccttgagtcaatacatcttcctgcacagctgcctgctgaacaagattctggaagggccctctgacgcctcagactccggccccatccctgtgatgaattttgcacaagcttgtgccaagagggcagccaatgccaatgccggtttcttgaaggagtacaggctcctgaagcaggccatcaaggatgagactggctctctgctgccctctcctgactataatcagaacagcatcgcctcctgtcatcattctcaggagcagttggccctggtggaggagagccctgctgataacatgctggcagcctcgctcttccctggtgggccgtctggtcgcgaccatgtggtgctgactggctcggccggaccaaaggaactctgggaaatggtgtgggaacatggcgcctatgtgcttgtctccctgggtctgcctgataccaaggagaagccacaagacatctggccaatggagatgcagcctattgtcacagacatggtgacagtgcacagagtggctgagagcaacacagctggctggcccagtaccctcatcagagttatacatggggacagtgggacggaaaggcaggttcaatgcctgcagtttccacactgcgagactgggagtgagctcccagctaacaccctactgaccttccttgatgctgtgggccagtgctgctcccggggcaatagcaagaagccagggaccctgctcagtcactccagcaaggtcacaaaccagctgagcaccttcttggctatggaacagctgctacagcaagcagggaccgagcgcacagtggatgtcttcagtgtggccctgaagcagacacaggcctgtggccttaagaccccaacgctggagcagtatatctacctctacaactgtctgaacagcgcattgaggaacaggctgccccgagctaggaagtgaccttgccctgctaggcatcacgttccagcaatccacccaggcctggcttccccaggagaacagatctattcggcctcacgctgtcaaagggcagagtctgggaataaagggtaaatctcgag

SEQ ID NO: 16 - DNA, 1737 bp, Mus musculus
  modified_base (699)..(699): a, c, g, t, unknown or other
ttggtggcagagcaaggcatcgtcgcagccggcgagcaagactggccagcgctcctcggctttccagcccgctctcttcgctcatcccgccgccttgcagcccgcggcccgcagcgcggtgatctggggctccacggggccgggctgagcggccgccgcccgccccgagccgccgccgccgcccggccgcccgcccggcttagccgccgaggcgcctggcggggtccgcgccgccgggggcgggcggctcgggctgcggggcggctggcgcgcgcgcccgcggggcggagaagcgggcccggcggccggcgagcatggaggagaagtacctgccggagctgatggcggagaaggactctctggacccctccttcacgcacgccctgcgcttggtgaaccgagaaatagaaaagtttcaaaagggagaaggcaaggaggaagagaagtacattgacgtggtgataaacaagaacatgaagctgggacagaaggtgctgattcccgtgaagcagtttcccaagttcaactttgtggggaagcttttgggtccgcgtggcaattccctgaagcgcttacaagaagaaacgttgacaaaaatgtccatccttggcaaaggtccatgagagacaaggcaaaggaggaagagccgaggaaaagtggagaagcgaagtactttcacctcaatgacgacctgcacgngctcattgaagtgttcgcacccccagcagaagcatatgcccggatggggcacgccttggaagagatcaagatattcctgatgcctgactataatgatgacatcaggcaggcacaactccaggagttaacatatttgtatgggagttcagaaaatgcagatgttcccagtgttcgagggatatctactttgcgtacgagagtgtaactacaccagcaataaccaggtgaagaggagatgtcacagccaggcctgttgcagttggggtaccacgtgggacaccgactccccgaggagtcctttccacccgagggccagtgagccggggaagaggccttctcactcccagagcaagaggtgtccccccaaccggatacagacctcccccgccacccccaacacaggagacctatggagagtatgactatgacgatgggtacggtactgcctatgatgagcagagctatgactcctatgacaacagctacagcaccccagcacaaagtgcagctgattactacgattatgggcatggactcagcgaggacgcttatgactcctatgggcaagaggaatggactaactcaagacataaggctcttcggcgaggacggcgaagggcgtctacagagaccagccatatggcagatactgattgtactgtctgatgttgtgaaatagccaatctccaccgtcctgtatactgttcaaagaaatgtcgaccaccttggactgtcagagagctccaagtgacttagagcagacaaaggacctgcttctggggaggccgcttaaggacactcacctcaccatcatgcctactcggcaaatgaaccactggctcgccaacgtgacagtcatcaatcgattattgttgttttgtcccagatttgtgtttttggaatgcttttatgaaacagtgtggtttttttattttaatttagagggtttttatttctttttaaagaaaattctattttgttgtgtgagaaacaaaaaaaaaaaatgctttgtattgtagctaataaaggctccccatc

SEQ ID NO: 17 - DNA, 680 bp, Mus musculus
ccccaattgcccactggacccaaaaaagatgtgctcggcaaagtctgaaggcccaagggagctctctgaagttacctcgccctcaccgtgcccagcattcggcttttcatctgccttctctgacgttgagagtctcggcaaggcccccacacccggtgtggctcctgagagcgttgggagcagctaccagtgccggatgcagacactgaatttctgtatggggactgacccaggccttgaacacctcctggtctcttcagtccccacccctggatcctcgacaccttcagcctctcaccgggccccactgcccctgccggctgactccaaagaaccctgggtggctgggagcttccctgtccagggaggttctggctatccactgggattacccccctgtctttaccggactccgggaatgttcttcttcgagtgattggctgcagcggcccctctgtagggctcctgtcaactgttctctggagactcagactggctatatgacctagggcactctgcaagaacccagccctggcaggccaaggactgtgaggatcagaaggcagaagtgagcagtcaggcaggtcccttgggggcctcctgacaaacttgggatgtggggaaatggaacccttaagcttttctctgtggttctcagggctaataaagccggtgtggtg

SEQ ID NO: 18 - DNA, 3089 bp, Mus musculus
ggtgcacaggggagcgagggcagggcgctcgcagggggcactcagagagggcccagggcgccaaagaggccgcgccgggctaatctgaaggggctacgaggtcaggctgtaaccgggtcaatgtgtggaatattggggggctcggctgcagacttggccaaatggacgggactattaaggaggctctgtctgtggtgagtgacgatcagtccctttttgattcagcatacggagcggcagcccatctccccaaggcagatatgactgcttcggggagtcctgactacgggcagccccacaaaatcaaccccctgccaccgcagcaggagtggatcaaccagccagtgagagtcaatgtcaagcgggagtatgaccacatgaatggatccagggagtctccggtggactgcagtgtcagcaaatgtaacaagctggtgggcggaggcgaagccaaccccatgaactataatagctacatggatgagaagaacggcccccctcctcccaacatgaccaccaacgaacggagagtcattgtgcctgcagaccccacactgtggacacaggagcacgttcgacagtggctggagtgggctataaaggaatacggattgatggagattgacacttccttcttccagaacatggatggcaaggaattgtgtaaaatgaacaaggaggacttcctccgagccacctccgcctacaacacagaagtgctgttgtcgcacctcagttacctcagggaaagttcactgctggcctataacacaacctcccatacagaccagtcctcacgactgaatgtcaaggaagacccttcttatgactctgtcaggagaggagcatggaacaataatatgaactctggcctcaacaaaagtcctctccttggaggatcacagaccatgggcaagaacactgagcagcggccccagccagatccttatcagatcctggggccaaccagcagccgcctagcaaaccctgggagtgggcagatccagctgtggcagtttctcctggaactactgtccgacagcgccaacgccagctgtatcacctgggaggggaccaacggggagttcaaaatgacggaccctgatgaggtggccaggcgctggggagagcggaagagcaagcccaacatgaattatgacaagctgagccgggccctccgatactactatgacaaaaacattatgaccaaagtgcatggcaaaaggtatgcctacaagtttgacttccatggcattgcccaggccctgcagccacatccaacagagacatccatgtacaagtatccctctgatatctcctacatgccttcctaccatgcccatcaacagaaggtgaactttgtcccgtctcacccatcctccatgcctgtcacctcctccagcttctttggagcagcatcacaatactggacctcccccactgctgggatctatccaaaccccagtgtcccccgccatcctaacacccacgtgccttcacacttaggcagctactactagaactaacaccagttggccttctggctgaagttccagctctcactttactggatactctggactctaaaaggcacagtagccttgaagagataagagaactggatgttctttcttttggatagaacctttgtatttgttcttctaaaaaaattattatttttatgttaaaaacttttgtttcctctacctgaaaaaaaaaaaagatcattccatgagccagtccaccagtttggattctcaacctcctatcatcgaatgagttaaatatttaggttactggaacggtttataccatgattctgagaaaggagtgcgcattttctttactctttttttttatgaccaaagcagtttcttatcagcacacgggtctcatcattgtaggattccctacgatcatgaatcatggacttgaccagggttggtctggtttgagacttagtaaaagtcaaggcaggatgtttataatcttatcttcggaggactcaattcagtggatggcaactggaacactggctctgaggccagtgaagttttttgcccaactggaatttaaaagatgtgtgtctatgtgtgtatttaagaagccattattattacaaaattcctcacaatgggcagtatgtgtttgggtgactcttctccccagaaatagtcagaatatgaacaaagaaagtttaacacaaactcagacactcctgacgggcagaggattaaataacatttttttggagggtttaataacatttttggaggggtttttttgtttgtttttgtttttgggggttttttttgtttgttttttgttttttggtttttggtttttttttgtttttttttttttttttggttttgatttttaatgacagtgagtcccagaactttgaaaagtcatggggatttctaaactcagattcgcaaacgctgtgcgtttgtcagaccaccagaccaaggtcaaacaatcagaaggcaactaactgtataaattatgcagagttattttcctatatctcacagtattaaaaaaataaataattaaaaattaaagaataagtaaacgagttgacctcggtcacaaatgcagttttactatcaaatcaatcattgttatttttttaaaatataatttgtacatctttgtcaatctgtacatttgggctatttgtacgtttttgtaactgtttttttttaataagcataatgtgactattgaaaacgaggagttaaaagtcactgagtttttaggaagaaaaacctaaaaatacagttatttaacacgcatgcccaaacaagatctgtttagacctacaacgctttagaaatgtttgtaaataacagagttgcaataacctgaaaaggacaaacaaacttttctctgtgcacacgaggcactctcctgctctatatatgcaatatatttttagatgtgcgaatatatatataatttttcaggtaatcgtgactttttaaacgatattgttaaggtgacaactcttagtccactgaagactaagttgtaaaataatttgaccttaataaattgtgccttcttctttttcttcttctccc

SEQ ID NO: 19 - DNA, 684 bp, Mus musculus
  modified_base (111)..(111): a, c, g, t, unknown or other
  modified_base (163)..(163): a, c, g, t, unknown or other
cgacatgtggcctgatgctacagaagtcagaagagggcattggatatcctcaaactggagtagagacagttgtgagccaccatgttggtactggggctcaaacccgtgacntatgcaagaacaagacatgctcttaactaacccaagccatctctccagtctntagtatttattatgtcttatctatgttgatttagtatggaaaaacaaactggtgtctggtttattttacataatgagatctacaattccaactattttcttacagaaggtgtggtatgactacatgaaaactctgctgtatgtacatacataccttacccatttatcagtaaggacctcggtaggcctattgtaaacagggctgcagtaaagaatgtaaaactcaatcttgtgtcacaggtatatctcaagatagtttgggaaacattcatacagggtcttatatgccactaaggacatatattttgttcaaactgcaatgtgaaccctgacagcttttaagaattgacatggttcagtttttatacactggagaatgtactggagggagaaaaaaatttcagatgtgcacttgagatatgtgctaggataagcttagcatccagtaggtgagaagaatgtgacatcaagttcattgtcatggttaggatgagcaataggactaaagctgctgccctttgc

SEQ ID NO: 20 - DNA, 1847 bp, Mus musculus
gcacaacctccaagatctcccttcctagaagatcactgccccccagcgggccaataaaccagggtagaggagggacgtggatgcaggatcttgggcctattacccaagctagtgctgcagagtggagttgggaggcccccctctgccgattccagtgggctacgaagcatttgctaatggcctactgagcgcggaagtaggccggttcctcccttactccctaatcatgctctgttcaggatcggaggcggcggggtttggaggctaaggcctttaggaagaccccagatctagaggcttctgggaggaaggcggggccgcgatgctctagaccgctcgcgccccttcctgagtctacctgaaggactccaagggcggtagagacggggtgtccctatgcctagactactttcgtccacccataggtcaaggtcttttcttcccagcaactctgttgcacaaggattccagcccttggcctcctccatatctccacccgcatgattcctccccacacaccccatgctccgttttgttcagttgtgaatgccgcgtcctgtcctggtgacaggagaacaaagttggtgaacgtcgcaccgagtgtccgagtgttccatgagcccctgggagcgggcggggggacggaagcccgggctgcctgcggccccaggcgatagtaccctatctgccttcgcaacgcccttgcgcgccggctcggagttatttctggccaggcggcagaattgtggtctgttgctgtagactcaggcaggctctcgggccaacgcctctccagaacgaagtaggccaccatcctctcgccatgggctcccggccccgtggggcgctgagcctgctgcttctgttgctagcgctgctcagccgcccagcctctggctgccccgcgccatgcagctgcgcagggacgctcgtggactgtgggcgccgcgggctgacctgggcgtcgctgccggctgccttccctcccgacaccaccgaattggtgctgaccggcaacaacctgacggcgctgccgcccgggcttctggacgcgttgcctgctctgcgcgcagcacacctgggcgccaacccctggcgctgcgactgccgcctattgccgctgcgcgcctggctggccggccgcccggagcgcgcgccctaccgcgacctgcgctgtgtcgcgcccccagcgctgcgcggccgcttgctgccctacgtggcggaggatgagctgcgggccgcgtgcgcacccggtctactctgctggggagcactggtggcccagctagcactgctggtcctcgggctgctacacgcgctgctattggcacttctactaggtcgcctgcggaggctgcgcgcgcgtgcgcgcgcacgctccatccaagagttctctctcacagccccgctggtggccgagtcggccagaggtggtgcatcctaagaaaggacaggcactgagcaacaaggacctgcaaactttacaggtccctgcaggaggaccctcaccttcacctggatccgccttggcctctacccttgcccaacctcccagacccgagctctgcaagcctgaatcaacatggtgccaaactgattccagtactaccagagtgaagcaaccttgagtcttcagagcctagagtgatggaacagcccagtctcctgccagactcctcactgaataaaccgttctcctcatttggcggtttctgtaccacccgactttgccaaattctagaaagggcctgagggaatgttgttaaaagggacataatcacttcttcacacgctgccaaactggcctagggcaagcaggagtcgatggataaaactccctgtaccca

SEQ ID NO: 21 - DNA, 2716 bp, Mus musculus
gagcccggcgccgcgcacgtgcccgccagacctgcaaacttgtgccaccggctatcctgcgtccccggggagcccaatcgcccggagcccgcacccctcccgtcagtctccaaccatgggttgcttcgaatgctgcatcaagtgtctgggaggagttccctatgcctccctggtggccaccatcctatgtttctctggagtggccttgttctgtggctgtgggcatgtggctcttgcaggcaccgtggcaattcttgagcaacacttctccaccaacaccagtgaccatgccttgctgagtgaagtgatccaactgatgcagtatgttatctatggaatcgcctcctttttcttcctgtatggcatcattcttctggcagaaggcttctacaccacaagtgcagtgaaagagctgcacggtgagtttaaaacaactgcctgtggccgatgcatcagtggaatgttcgtgttcctcacctatgtgctgggagtggcctggctgggtgtgttcggcttttccgcagtgccagtgtttatgttctacaacatctggtcaacctgtgaagtcatcaagtccccacaaagcaacgggacctcgggtgtggagcagatctgtgtggatgtccggcaatatggtatcattccttggaatgctttcccaggcaaaatctgtggctcggccttggagaacatctgcaacacgaatgagttctacatgtcctatcacctgttcattgtggcttgtgctggagctggtgccaccgtcattgccctgatccacttcctcatgatactgtctcctaactgggcttacttaaaggatgcaagcaaaatgcaggcttaccaggatatcaaagcaaaggaagagcaggaactgcaagatatccagtctcgctcaaaagaacaactcaattcttacacttaaaagtgtttgccagagcgtgtcagccaatgaattcacagctctgacacatcatcagacagctgctctgcagtacagatgtgtatcccaccaaactaatgtagacgtaccaacatttcactgtctgtctcaaactgctggggtggatctctaggaaaaccttccagtgggtaaatcagtttctttagaacaaatattggaggtttcactttagccattttaaaaggcaacacttttgacagaatgaccgttcatcctttgcaaagtcgtggcatgtccagttaactgctagagcagttttaacacgggatagaatcacatcacgttccttactggggacctatggcatgccagaatcaaaggatatgaccctagatttacatatgccacctgtcttcaagtgttatcaaaatagaatcagtgtcaagttcatttttgataactgacctttattaacctttggctcatcaaagataatgtgattcttccaaacttaaaactcagcaccctcacggtctcacacattcgaatgtttcccaagccactgagaaacctatcttctagtaataggaaaatgagctgcaagtgtgctaaatgtatcagtgcagaagctggattctgacccgagctctgcaaaatgagcttcccagttgatcacatcggaacaaaatgggactgaggatttggtgatcactattgtttggaaataaatgtcagctctgccttaatatttgctttcaatttctaatcatttatattgtaaccagaaacccaaaattcctacatagattattttgttccatgaatatctttcttaagaagtgttaccttgttaaagtgactaccattctaaaccatttttaagtggtctggacagtgagtttacagtttcatatcaactatctaaaacctaactgcaaattgaccacagacctctgaccttctacttttatagactttaatacataagtaatttaaattagggttggtatttatttcactgttttcctatctaaatcttaatttcctggaataataatgtttgatattcagcaagaaaactgcttgagtttaagccattttcaaaagaaacttgccttctaactcattgtgttccagaacattaagtgactaataggtactgggtattagtgatggtaagttttgtgttcttctttctggaatgatccatataactgtggggtgcatcagtgcttttcaaaggggctgcatactatagggttaactatgtatattcatgttaagagttaacttgtggtttggctgtttcctggattttaaaacatatacatgtgcagagatgtattcaaatgaaaggaagcatatctttatcaagatgctagtaaaactgaacatcaactataatatttcatttggattttttttcttttggataatgccgagaaacgcctaattggattccttttaattgggagacgctctcttctgtgtagaacagttgttccaagatagcttagtgttttgttttcctgttgcatgacagaattattgtttccagcagtggaggtgctgttaagagtccagtgttctagaagaggcggtgtctaaagcctaattttacttttctaattctggtagctattgccaggaacttttgaaagttttgttgaagtagtctaatattttttatgtaaagagcattaaattttgctatgtataaatttttgtaacctaacagtgaatcaatattttctatcaatgccaagggcttcctgtagttctattcaagtgttacaataaatatttgtagat

SEQ ID NO: 22 - DNA, 262 bp, Mus musculus
tttcacatcttgtttgggtttagctattgcttacctgcttctaatttccagttccccctctagaaatagacactcaacgttagttcccctaaaataagattcatgatttttccttcattccctacgcttttccctgtggctggggaaaggtgttcttttcctagctattctagcctaagcctcggctttgggcatcatattgaacatgacgtttctgtgaggttgtcactagggcctggtgattatatattttttttttttc

SEQ ID NO: 23 - DNA, 4035 bp, Mus musculus
gtacttagctggtcctggggcagcagcgggaagggactgaagaggggtgctgaggtgaaagattggaagacccggaaagatcagctagatttcggaaaccagaaacaccctcggggagacctggggctcccggcgcgcgacgatttcctcgcactagctgggagagcgttgatcccatggccaggattccgaggtgcgattttctccggccccccggaatctactatcttattacttccttgctcgctggactgttcttaccaccggctatcgccttcaatctggatgtgatgggtgccatacgcaaggagggagaacccggcagcctattcggcttttcggtggccctgcaccgacaattacagccccgaccccagagctggctgctggtgggcgctccccaggccctggctcttcctggacagcaggcaaaccgcaccggaggcctctttgcttgtcccctgagcctagaggagacagattgctacagagtggacattgacaggggagctaacgtgcagaaggagagcaaggagaaccaatggctgggagtcagtgtccggagccaggggccagggggcaagattgttacgtgtgcacaccgatatgagtctcgacagagagtggaccaggctttggagactcgggatgtgattggccgctgctttgtgctaagccaggacctggccatccgtgatgagctggatggtggggagtggaagttctgtgaggggcgcccccagggccatgaacagtttgggttctgtcagcagggcacagctgccaccttctcccctgacagtcactacctcgtctttggggctccaggaacctataactggaaggggttgctttttgtgaccaacattgatagctcagaccctgaccagctggtgtataaaactttggaccctgctgaccggctcacaggaccagccggagacttgaccttgaatagctatttaggtttctccatcgattctgggaagggtcttatgcgctcagaagagctgagttttgtggcaggggccccacgtgccaaccacaaaggggctgtggtcattctgcgcaaggatagcgccagccgcttgatacctgaggttgtgctgtctggggagcgcctgacctctggctttggctactcactggctgtgactgatctcaacaatgatggctgggcagacctgattgtgggtgccccctacttctttgaacgccaagaagagctgggaggtgctgtgtatgtgtacatgaaccagggtggccattgggcagatatctctcctctccgaatctgtggctcccctgattccatgtttgggatcagtttggctgtattgggggacctcaaccaagatggcttcccagacattgccgtgggagctccctttgacggagatgggaaggtctttatctaccatgggagcagccttggggtggttgtcaaaccttcacaggtgctggagggcgaggcggtgggtatcaagagctttggttactccctgtctggtggcctggatgtggatggaaatcactacccagacctgcttgtgggctccctggctgataccgctgctctgttcagggccagacctgttctacatgtctcccaagagatcttcattgaccccagagccatcgatctggaacaacccaactgtgccgatggacgcttggtctgtgtggacataaagatctgtttcagctatgtcgctgtgcccagcagctacagccctagtgtggccttagattatatgttagatggggacacagaccggaggctccggggccaggttccacgtgtgacgtttctgagccgaggcctggatgacctcaggcatcagtcctccggcaccgtgtggctgaagcaccaacatgaccgagtctgtggagatactgtgttccagctgcaggaaaacgtcaaagacaagctacgggccattgtggtgaccctgtcatatggtctccgaacccctccattagggaggcaagcacctggccaggagctccccactgtggctcccatcctcaatgctcaccagcccagcacccagaggactgagatccactttctgaagcaaggctgcggtgaagataagatctgtcagagcaacctccagctcgagcggtaccagttctgttccaggatcagcgacacagagttccaggctctgcccatggatctggatggaaggaccgccctgttcgcattgagtgggcagccgttcataggcctggaactgacagtcaccaacctgccctctgaccctgcccggcctcaggcagatggggatgatgctcatgaagcacagctcttggtcactctcccagcctctctacggtactcaggagtccgtgctctggactctgtggagaagccgctctgcctgtccaatgacagcgcctctcatgtcgagtgtgagctggggaaccctatgaagagaggcgctcaggtcactttttacctcatcctcagcacctctgggatcactattgagaccacagagctggaggtgaaattgctgttagccacgatcagtgagcaggagctggatccggtctccgttcgggctcatgtcttcattgaattgccactgtccatttcaggggtggccactccccagcaactcttcttctctggcgaggtgaagggcgaaagtgccatgcgatctgagagggacgtgggcagcaaagtcaagtatgaggtcacggtctccaatcaaggccagtctctcaatactctgggctctgcgttcctcaacatcatgtggccccacgagatcgccaatggaaagtggctgctgtaccccatgcgggtagagctggagggcggacaggggcctggcaagagagggatctgttccccaagacccaacatcctccagctggatgtggacagcagggataggaggcggcgagagctggggcagccggagccgcaggagcctccagagaaggtggagcctagcacatcctggtggccagtgtcctctgctgagaagagaaacgtgactctggactgcgcccagggcacggccaagtgtgtggtgttcagctgcccactctacagctttgatcgtgcagccgtgcttcacgtctggggccgcctctggaacagcacctttctggaggagtacatggccgtgaaatccctggaagtgatcgtccgagccaacatcacagtgaaatcctccattaagaacttgttgctcagagatgcatccacagtgattccagtgatggtgtacttggaccccatggccgtggttgtggaaggagtcccctggtgggtcatcctcctggcagtgctggctgggctgttagtcctggccttgctggtactgctgctgtggaagctgggattcttcaagcgggcgaagcaccccgaggccaccgtgccccagtaccacgcagtgaagatccctcgggaagaccgacagcagttcaaggaggagaagacaggcaccatccagaggagtaactggggcaactcccagtgggagggctccgacgcacaccccatcttggctgccgactggcatcctgagctgggtcctgatggacatccggtgccagccactgcctaacatctgctgtcccaagcccagcccgtgggttccttccgcccttttcccaagatggctccttgggatggagatagtggagtaagttgctagcatcacgttgagatatggcaggctctgctttctcaggagcacagatctttctcccaccaggagaaccacccctccatcttccccatacaatgctgtgagacgagggggcatggctggaagggcaggcatgtcctgatacagggtggggagaaggggttctgagctccctctcacccaccctgtaaaacctgtcttccccaaagtgccttagacagagggtcagggaagagactgtgtcactgtctcagggccctttactcccaagtctcccctgccctctggccttactgtgctgtaccagtccagtggttttgtctatttattaaaaagtatttgacaataaaaaaaaaaaaaaaaa

SEQ ID NO: 24 - DNA, 1851 bp, Mus musculus
gtcgcgtcgggattgtaactgtaatgggcaccgaggggaaagccgggaggaaactgttgtttctcttcacgtctatgatcctgggctctttggtacaaggcaagggttcggtgtacactgctcaatctgacgtccaggttcccgagaacgagtccatcaaattgacctgcacctactctggcttctcctctccccgagtggagtggaagttcgtccaaggcagcacaactgcacttgtgtgttataacagccagatcacagctccctatgcggaccgagtcaccttctcatccagtggcatcacgttcagttctgtgacccggaaggacaatggagagtatacttgcatggtctccgaggaaggtggccagaactacggggaggtcagcatccacctcactgtgcttgtacctccatccaagccgacgatcagtgtcccctcctctgtcaccattgggaacagggcagtgctgacctgctcagagcatgatggttccccaccctctgaatattcctggttcaaggacgggatatccatgcttacagcagatgccaagaaaacccgggccttcatgaattcttcattcaccattgatccaaagtcgggggatctgatctttgaccccgtgacagcctttgatagtggtgaatactactgccaggcccagaatgggtatgggacagccatgaggtcagaggctgcacacatggatgctgtggagctgaatgtggggggcatcgtggcagctgtcctggtaacactgattctccttggactcttgatttttggcgtctggtttgcctatagccgtggatactttgaaagaacaaagaaagggactgcaccgggtaagaaggtcatttacagccagcccagtactcgaagtgagggggaattcaaacagacctcgtcgttcctggtgtgacctgctgcggctcctccgttgtccatttgccttactcaggtgctacaggttccagcccctgctggctgtagctgcacaggatgccttcaatgtcttctaggtcccacaggaccccttgcttttattctagctaggatataaatttaaaaacatcatctacttccccctcctctttcccaccctccctcctttccttaccaccattgggtggcccgagactaattacaaagttttcgttccccattcctatgtgggattgggcaagagtcctagactagacagtaatagtggctgggctgacaggaacccaaaccaatacttggctgtaaaggcctctgaataaggactttaagcctagctccctgctttctcctccccggatggggtgccagctactctagagggggagctgcagagaggaggggctgaggatggtgacctcaggtctctagtcttcggagcttctcttctgtctccacaaaatgtgccactgggattctcctggattcaaagtaaactgacatggtgtccgtacgaggtgggagagctctgttagctcccaagagacttggagtaagaaagatttaaagtgatctaaagaaaaggctggaactggtggccattagtcactcttcatttggctggaactaccgcacggaccctttgaagatatgtgtggatggagaagatacgagctttatagtcttggctctttggtggcctcgtgtgtgtgtgtgtgtgtgtgtgtgtgtgtgtgtgtgtgagagagagagagagagagagagagagagagagagagttgtaaattgatattgttatatagaagggctttctagctctttggcaaggttgtgtttctgtgtgtttatatttgacagatgttgctggaaataaaaacttcatttgacagaaaaaaaaaaaaaaa

SEQ ID NO: 25 - DNA, 5182 bp, Mus musculus
gtgcccttgagactccctcgccccctccggttttgaggaaggggtggctgatatctacaacctgagttctgcccaggaccaccccgggagagaacggctgtgtgtagcggggtgcgggtggagggaggggatatggcacattccagaaggatctctggaccgcagcctcagtaccacgccctcggcggggccaggactgagtcagggagaagagtcgataaaacacctgatcgagggaaaaggaaggcacagcagagcgaagactcggcgcccggcaggcacccgcagcggcggagcgcggcccggccatgcctgcgctctggctcagctgctgccttggtgtcgcgctcctgctgcccgcagcccaggccacctccaggagggaagtctgtgattgcaatgggaagtccaggcaatgtgtctttgatcaggagctccatcgacagacaggcagcgggttccgttgcctcaactgcaatgacaatacagcgggggttcactgcgagcggtgcagggaggggttttaccgacatcgagacagagaccgctgcctaccctgcaactgccactcaaagggttccctcagtgctggatgtgacaactctggacaatgcaggtgtaagccaggtgtgacaggacaaagatgtgaccgatgtcagccaggcttccatatgctcaccgatgctggatgcacccgagaccaggggcaactagattccaagtgtgactgtgacccagctggcatctctggaccctgtgattctggccgatgtgtctgcaaaccagccgtcactggagagcgctgtgataggtgccgaccaggctactatcatctggaccgggcaaaccctgagggctgtacccagtgtttctgctatgggcattcagccagctgccacgcctctgccgacttcagtgtccacaaaatcacttcaactttcagtcaggatgtggatggttggaaggcggttcagagaaacggggcacctgcaaaactccactggtcacagcgccatcgggacgtgtttagttctgcccgaagatcagaccccgtctatttcgtggcccctgccaaattcctcggtaaccagcaagtgagttacgggcagagcctgtcttttgactaccgcgtggacagaggaggtagacagccgtctgcctacgatgtgatcctggaaggtgctggtctacagatcagagctcctctgatggctccaggcaagacacttccctgtgggatcacaaagacttacacattcagactgaatgaacatccaagcagtcactggagtccccagctgagttatttcgaatatcgaaggttactgcggaacctcacagccctcctgatccgagctacgtacggagaatatagtacagggtacattgataacgtgaccctggtttcagcccgccctgtctctggagccccagccccttgggttgaacgttgtgtatgccctgctgggtacaagggacaattctgccaggaatgtgcttctggttacaaaagagattcggcaagattggggccttttggcgcctgtgttccctgtaactgccaagggggaggggcctgtgatccagacacgggagattgctactcgggggacgagaatcctgacattgagtgtgctgactgtcccatcggtttctacaatgacccacatgacccccgcagctgcaagccatgtccctgtcacaatgggttcagctgttcagtgatgcctgagacagaggaggtggtgtgtaacaactgtccccctggggtcacaggtgcccgctgtgagctctgtgctgatggcttctttggggatccctttggggaacgtggcccagtgaggccttgtcaacgctgccaatgcaacaacaacgtggaccccaatgcctctgggaactgtgaccagttgacaggcagatgcttgaaatgtatctacaacacggccggtgtctactgtgaccagtgcaaagcaggttactttggagacccattggctcccaacccagcagacaagtgtcgagcttgcaactgcagccccatgggctcggagcctggagagtgtcgaggtgatggcagctgtgtttgcaagccaggctttggcggcctcaactgtgatcacgcagccctaaccagttgtcctgcttgctacaatcaagtgaagattcagatggaccagtttacccagcagctccagagcctggaggccctggtttcaaaggctcagggtggtggtggtggtggtacagtccccagtggggagctggaaggcaggatgcagcaggctgagcaggcccttcgagacattctaagagaagctcagatttcagaaggggcaatgagagcccttggcttccggctggccaaggcaaggagccaagagaacgactacaagacccgcctggatgacctcaagatgactgcagaaaggatccgggccctgggcagtcagcatcagaacagagttcaggatacgagcagactcatctctcagatgcgcctgagtctggcaggaagcgaagcttccctgcaaaacactaatatccattcttctgagcactacgtggggccgaatggatttaaaagtctggctcaggaggctacaagattggcagacagccacgctgagtcagctaacgcaatgaagcaactagcaagggaaactgaggactactccaaacaagcactttcattggcccgcaaggctctgagtggaggaggcggaagtggcgtcttggacagctccgtggtacaaggtcttatgggaaaattagagaaaaccaagtccctgagccagcagctgtcaagggagggcacccaagccgacattgaagctgataggtcgtatcagcacagtctccgcctcctggattctgcctctcagcttcagggagtcagtgatctgtcctttcaggtggaagcaaagaggatcagacaaaaggctgattctctctcaaacctggtgaccagacaaacggatgcattcacgcgtgtgcgaaacaatctggggaactgggaaaaagaaacacggcagcttttacagactggaaaggataggagacagacttcagatcagctgctttcccgtgccaaccttgctaaaaacagagcccaagaagcgctaagtatgggcaatgccactttttatgaagttgagaacatcctgaagaacctccgagagtttgatctgcaggttgaagacagaaaagcagaggctgaagaggccatgaagagactctcctctattagccagaaggttgcagatgccagtgacaagacccagcaagcagaaacggccctggggagcgccactgccgacacccaacgggcaaagaacgcagctagggaggccctggagatcagcagcgagatagagcaggagatagggagtctgaacttggaagctaatgtgacagcagatggggccttggccatggagaagggactggccactctgaagagcgagatgagagagatggagggggagctggccagaaaggagctggagtttgacacggataaggacacggtgcagctggtgattactgaagcccagcaagctgatgccagagccacgagtgccggagttaccatccaagacacactcaacacattggacggcatcctacacctcatagaccagcctggcagtgtggatgaagaagggatgatgctattagaacaagggcttttccaagccaagacccagatcaacagtcgacttcggcccttgatgtctgacctggaggagagggtgcgtcggcagaggaaccacctccatctgctggagaccagcatagatggaattctagctgatgtgaagaacctggagaacattcgagacaacctgcccccaggctgctacaatacccaagctcttgagcaacagtgaagttgtcatagagatttgtccactgtggtgaaaggacacagacctcaggggtcaggagccatctcgtgtggatgggctgggctcaggctatctgaacacatttaatgggtttgttcaggtccaattccatccctgagaccatgggcgggtggatgtcttcctgtaccaatataatactgtttgcttcctgatgctggcagtgaggcagatagcgttgagtatgagattgatcaaggaccaacaaatgctgcgctcagaacagtgacaaactgaattctgggatatagaaagtcctgctgctatgtcaggacaagagatctaatcccgctgtggccagtaaagtactcttgcttcacccactagacgttttttgtccaccacatttcctccagtgcccacccaatacatgagtatgtcctccacttcatgctgagtgcagagagcagtgatgggtatagatctggaaatctggcccatgtggagcagtggtgcccgctgccacccctcaccttcatgctctcggcctgagtgtaacagcctttctcctaatggtgcgaacaacttagaggctgtattttttatgaaagcatcttttaccagccaagcaatcattgggaaagtatttcctttgagtttcaaagtgatataagaaaatgtgtcctgggcactaaaggaagtggagttatctaaaagatatattcatcataatccaatcttcctttggaaacactaaaactcatatacatctgtgtattgtatcttattttctctttctccctaaatcagggataatccagccttctaacatatatttattgcgtcactactgtgtgccaggggtgagtggaacagtatggacagtctctactctcatggagttgagtgtctagtgagaagaacaaacattagaataagtaaatggaaactcccatgccttgttcatctcatgtgatatttattgcagtcacccaccctttggtttgaaacctcttttcttaataatgtgttgcaagacattcccatgagggtacttgagttagagcaaagttgagatcgctctgagttgtacacatttctctatgttccagccgtctctccaccccttcccacaacagactgttgccacagacggttgcatcagggcaataccagtgggaattgctgaaggaaccgaggcattgggacctcagtttggaagacctgtactgtctcacctctgtatctccttgtcttttcatggatgtgtattaaataaaggagtgttagatgctgggaaaaaaaaaaaaaaaaaa

SEQ ID NO: 26 - DNA, 950 bp, Mus musculus
  modified_base (508)..(508): a, c, g, t, unknown or other
  modified_base (516)..(516): a, c, g, t, unknown or other
  modified_base (580)..(582): a, c, g, t, unknown or other
  modified_base (598)..(599): a, c, g, t, unknown or other
  modified_base (656)..(657): a, c, g, t, unknown or other
  modified_base (674)..(675): a, c, g, t, unknown or other
  modified_base (696)..(696): a, c, g, t, unknown or other
  modified_base (708)..(708): a, c, g, t, unknown or other
  modified_base (767)..(767): a, c, g, t, unknown or other
aaaactcattagtcaaatacttttaattgtgccaagaggacgctaacagttagcctttggcaattcccaaacatacagtgaaccccaaataaaacaaagtaaaattgcactgttacgaggaaacaagtccgtgagagcagagaggaagcctcacttaagggacagcgacttcaaggagtctgttgttctttcgtttgcaggttggcacgctcccatttttctggttgccttgaataaacttcacacatactttgtcctgtctgaactgtaccaggaactcatcggaaatctcgatgttgagcttctgtttagtttggctgagagtcgtgcgatacagcttggttgccatttcaatcaggtggtcactgctgaagagaaagtcccctttactagccgcttctgaaccctccttgaggtgcactgcaaagaaaccatcgttctgggaactcatggaaaccttggtcacatctaccagggggaccctcgacttgatctgcccagactttgngtcagcanggagaagggtatggtttgtaagaggaaaatccgagatgtactcttcccattagcccgataaatnnntgtcacacctcagcanntatgatcttctcttcatggcatctttgagttcttatattttgggtcttgtgatttcnnagtagctcttgaatggnntgccacactagaagatataangctttctgcttngagagtcgctggctcgactctctcataataggttctgtgtctgggaatgatcctgattnttacacctccaaggggagatcttttagctcttggagtcaatcaaaacaggaaggtctgatgccattttatttacgggcacaggaggtttatttccatccacacgatttttgcacattttgaggaaactagattttttacgattggtaaaaattcgtgttctgggctctgtcaccggaggccaa

SEQ ID NO: 27 - DNA, 950 bp, Mus musculus; identical to SEQ ID NO: 26
  modified_base (508)..(508): a, c, g, t, unknown or other
  modified_base (516)..(516): a, c, g, t, unknown or other
  modified_base (580)..(582): a, c, g, t, unknown or other
  modified_base (598)..(599): a, c, g, t, unknown or other
  modified_base (656)..(657): a, c, g, t, unknown or other
  modified_base (674)..(675): a, c, g, t, unknown or other
  modified_base (696)..(696): a, c, g, t, unknown or other
  modified_base (708)..(708): a, c, g, t, unknown or other
  modified_base (767)..(767): a, c, g, t, unknown or other

SEQ ID NO: 28 - DNA, 489 bp, Mus musculus
  modified_base (338)..(338): a, c, g, t, unknown or other
  modified_base (367)..(367): a, c, g, t, unknown or other
  modified_base (395)..(395): a, c, g, t, unknown or other
  modified_base (409)..(409): a, c, g, t, unknown or other
  modified_base (430)..(430): a, c, g, t, unknown or other
  modified_base (436)..(436): a, c, g, t, unknown or other
  modified_base (445)..(445): a, c, g, t, unknown or other
  modified_base (452)..(452): a, c, g, t, unknown or other
  modified_base (455)..(456): a, c, g, t, unknown or other
  modified_base (469)..(469): a, c, g, t, unknown or other
  modified_base (478)..(478): a, c, g, t, unknown or other
gcaccaaattagaacaattttattattaacataatcccaatgtatttacattatcctcccaaataagaaacaatttaattccagagtttaaaatgtggtttccaaaatgaatccttattgttaattttgaagaaaaaaaatcaaaaagccctgaaaacgaattctaacttaattttgatctgactaaaatacacaccttgtaccaatcagctctctcatacaaaaaaaatgcatattataaataaaactttcaaaagtgatcttggatgttttattgcacatcaaagagaagatctgccagtctgaacggctctcagcctcttcttatcatgcagttncaaaagctaatgaccctgggggggatacnctggggcacatccaggggcctatctcangcttctctggaacnggaccaagcattctaaagccngcttcnggggctttntcctaanggnnaacgggtctggancccataaanggggatgttta

SEQ ID NO: 29 - DNA, 9193 bp, Mus musculus
gtggtgtgcgtcaacgtccgatccccgccggccaccccaagaggccgccgcccgggctgcgggcagctggcgagcaggcatgccacggctcctgacgcccttgctctgcctaacgctgctgcccgcgctcgccgcaagaggcttgagatgctcccagccaagtgggacctgcctgaatggaggtaggtgcgaagtggccagcggcactgaagcctgtgtctgcagcggagcctttgtgggccaacgatgccaggactccaatccttgcctcagcacaccgtgtaagaatgctggaacgtgccacgttgtggaccatggtggcactgtggattatgcctgcagctgtcccctgggtttctctgggcccctctgcctgacacctctggacaacgcctgcctggccaacccctgccgcaatgggggcacctgtgacctgctcactctcacagagtacaagtgccgctgcccaccagggtggtcaggaaaatcatgtcagcaggctgacccctgtgcctccaacccctgtgccaatggtggccagtgcctgccctttgagtcttcatacatctgtcgctgcccgcctggcttccatggccccacctgcaggcaagatgttaatgagtgcagccagaaccctgggctgtgccgccatggaggcacctgccacaatgagatcggctcctatcgctgtgcctgccgtgccacccatactggtccccactgtgaactgccctatgtgccctgcagcccctcaccctgccagaatggaggcacctgccgtcctacaggggacaccacccacgagtgtgcctgcttgccaggttttgctggacagaactgtgaagaaaatgtggatgactgtccaggaaacaactgcaagaatgggggtgcctgtgtggacggcgtgaatacctacaattgccgctgcccaccggagtggacgggtcagtactgtacagaggatgtggacgaatgtcagctcatgcccaatgcctgccagaatggcggaacctgccacaacacacacggcggctacaactgtgtgtgtgtcaatgggtggactggcgaggactgcagtgagaacattgatgactgtgccagtgccgcctgtttccagggtgccacttgccacgaccgtgtggcttccttctactgcgaatgtccgcatgggcgcacaggtctgctgtgccacctcaacgatgcgtgcatcagcaacccctgcaacgagggctccaactgtgacaccaaccctgtcaacggcaaagccatctgcacctgcccctcggggtacacagggccagcctgcagccaggacgtggatgagtgtgctctgggtgccaacccttgtgagcacgcaggcaaatgcctcaacacactgggttcttttgagtgccagtgtctacagggctacacgggaccccgctgtgagattgatgttaatgagtgcatctccaacccatgtcagaatgatgccacttgcctggaccagattggggagttccaatgcatatgtatgccaggttatgaaggtgtatactgtgaaatcaacacggatgagtgcgccagcagcccctgtctgcacaatggccactgcatggacaagatcaatgagttccaatgtcagtgccccaaaggcttcaacgggcacctgtgccagtatgatgtggatgagtgtgccagcacaccatgcaagaacggtgccaagtgcctggatgggcccaacacctatacctgcgtgtgtacagaaggttacacagggacccactgcgaagtggacattgacgagtgtgaccctgacccctgccactatggttcctgtaaggatggtgtggccacctttacctgcctgtgccagccaggctacacaggccatcactgtgagaccaacatcaatgagtgccacagccaaccgtgccgccatgggggcacctgccaggaccgtgacaactcctacctctgcttatgcctcaagggaaccacagggcccaactgtgagatcaacctggatgactgcgccagcaacccctgtgactctggcacctgtctggacaagattgatggctacgaatgtgcctgtgaaccaggctacacaggaagcatgtgtaacgtcaacattgacgaatgtgcgggcagcccctgccacaacgggggcacttgtgaggatggcatcgcgggcttcacttgccgctgccccgagggctaccatgaccccacgtgcctgtccgaggtcaacgagtgcaacagtaacccctgcatccacggagcttgccgggatggcctcaatgggtacaagtgtgactgtgcccctgggtggagtggaacaaactgtgacatcaacaacaacgagtgtgagtccaacccttgtgtcaacggtggcacctgcaaggacatgaccagtggctacgtatgcacctgccgagaaggcttcagtggccctaattgccagaccaacatcaacgaatgtgcctccaacccctgcctgaaccaggggacctgcattgatgatgtcgctggatacaagtgcaactgtcctctgccatatacaggagccacgtgtgaggtggtgttggccccatgtgctaccagcccctgcaaaaacagcggggtatgcaaggagtctgaagactatgagagtttttcctgtgtctgtcccacaggctggcaaggtcaaacctgcgaggttgacatcaatgagtgtgtgaaaagcccatgtcgccatggggcctcctgccagaacaccaatggcagctaccgctgcctctgccaggccggctatacaggtcgcaactgtgagagtgacatcgatgactgccgccccaacccgtgtcacaatgggggttcctgcaccgatggcatcaacacagccttctgcgactgcctgcccggcttccagggtgccttctgtgaggaggacatcaatgaatgtgccagcaatccctgccaaaatggtgccaattgcactgactgtgtggacagctacacatgtacctgccccgtgggcttcaatggcatccactgcgagaacaacacacctgactgtactgagagctcctgcttcaatggtggtacctgtgtggatggtatcaactccttcacctgtctgtgtccacctggcttcacgggcagctactgtcagtatgatgtcaatgagtgtgattcacggccctgtctgcacggtggtacctgccaagacagctatggtacttataagtgtacctgcccacagggctacactggtctcaactgccagaaccttgtgcgctggtgcgactcggctccctgcaagaatggtggcaggtgctggcagaccaacacgcagtaccactgtgagtgccgcagcggctggactggcgtcaactgcgacgtgctcagtgtgtcctgtgaggtggctgcacagaagcgaggcattgacgtcactctcctgtgccagcatggagggctctgtgtggatgagggagataaacattactgccactgccaggcaggctacacgggcagctactgtgaggacgaggtggacgagtgctcacctaacccctgccagaatggagctacctgcactgactatctcggcggcttttcctgcaagtgtgtggctggctaccatgggtctaactgctcagaggagatcaacgagtgcctgtcccagccctgccagaatgggggtacctgcattgatctgaccaactcctacaagtgttcctgcccccgggggacacagggtgtacactgtgagatcaatgttgatgactgccatcccccccttgaccctgcctcccgaagccccaagtgcttcaacaatggcacctgtgtggaccaggtgggtggctatacctgcacctgcccaccaggcttcgtcggggagcggtgtgagggtgatgtcaatgaatgtctctccaacccctgtgacccacgtggcacccagaactgtgtgcagcgtgttaatgacttccactgcgagtgccgggctggccacactggacgccgctgtgagtcagtcatcaatggctgcaggggcaaaccttgcaagaatgggggtgtctgtgccgtggcctccaacaccgcccgtggattcatctgtaggtgccctgcgggcttcgagggtgccacatgtgagaatgatgcccgcacttgtggcagcttacgctgcctcaacggtggtacatgcatctcgggcccacgtagtcccacctgcctatgcctgggatccttcaccggccctgagtgccagttcccagccagcagcccctgtgtgggtagcaacccctgctacaatcagggcacctgtgagcccacatccgagaaccctttctaccgctgtctatgccctgccaaattcaacgggctactgtgccacatcctggactacagcttcacaggtggcgctgggcgcgacattcccccaccgcagattgaggaggcctgtgagctgcctgagtgccaggtggatgcaggcaataaggtctgcaacctgcagtgtaataatcacgcatgtggctgggatggtggcgactgctccctcaacttcaatgacccctggaagaactgcacgcagtctctacagtgctggaagtattttagcgacggccactgtgacagccagtgcaactcggccggctgcctctttgatggcttcgactgccagctcaccgagggacagtgcaaccccctgtatgaccagtactgcaaggaccacttcagtgatggccactgcgaccagggctgtaacagtgccgaatgtgagtgggatggcctagactgtgctgagcatgtacccgagcggctggcagccggcaccctggtgctggtggtgctgcttccacccgaccagctacggaacaactccttccactttctgcgggagctcagccacgtgctgcacaccaacgtggtcttcaagcgtgatgcgcaaggccagcagatgatcttcccgtactatggccacgaggaagagctgcgcaagcacccaatcaagcgctctacagtgggttgggccacctcttcactgcttcctggtaccagtggtgggcgccagcgcagggagctggaccccatggacatccgtggctccattgtctacctggagatcgacaaccggcaatgtgtgcagtcatcctcgcagtgcttccagagtgccaccgatgtggctgccttcctaggtgctcttgcgtcacttggcagcctcaatattccttacaagattgaggccgtgaagagtgagccggtggagcctccgctgccctcgcagctgcacctcatgtacgtggcagcggccgccttcgtgctcctgttctttgtgggctgtggggtgctgctgtcccgcaagcgccggcggcagcatggccagctctggttccctgagggtttcaaagtgtcagaggccagcaagaagaagcggagagagcccctcggcgaggactcagtcggcctcaagcccctgaagaatgcctcagatggtgctctgatggacgacaatcagaacgagtggggagacgaagacctggagaccaagaagttccggtttgaggagccagtagttctccctgacctgagtgatcagactgaccacagacagtggacccagcagcacctggacgctgctgacctgcgcatgtctgccatggccccaacaccgcctcagggggaggtggatgctgactgcatggatgtcaatgttcgaggaccagatggcttcacacccctcatgattgcctcctgcagtggagggggccttgagacaggcaacagtgaagaagaagaagatgcacctgctgtcatctctgacttcatctaccagggcgccagcttgcacaaccagacagaccgcaccggggagaccgccttgcacttggctgcccgatactctcgttcagatgctgcaaagcgcttgctggaggccagtgcagatgccaacatccaggacaacatgggccgtactccgttacatgcagcagtttctgcagatgctcagggtgtcttccagatcctgctccggaacagggccacagatctggatgcccgaatgcatgatggcacaactccactgatcctggctgcgcgcctggccctggagggcatgctggaggacctcatcaactcacatgctgacgtcaatgccgtggatgacctaggcaagtcggctttgcattgggcggccgcggtgaacaatgtggatgctgctgttgtgctcctgaagaacggagccaacaaggacatgcagaacaacaaggaggagactcccctgttcctggccgcccgtgagggcagctatgagactgccaaagtgttgctggaccactttgccaaccgggacatcacggatcacatggaccgattgccgcgggacatcgcacaggagcgtatgcaccacgatatcgtgcggcttttggatgagtacaacctggtgcgcagcccacagctgcatggcactgccctgggtggcacacccactctgtctcccacactctgctcgcccaatggctacctgggcaatctcaagtctgccacacagggcaagaaggcccgcaagcccagcaccaaagggctggcttgtggtagcaaggaagctaaggacctcaaggcacggaggaagaagtcccaggatggcaagggctgcctgttggacagctcgagcatgctgtcgcctgtggactccctcgagtcaccccatggctacttgtcagatgtggcctcgccacccctcctcccctccccattccagcagtctccatccatgcctctcagccacctgcctggtatgcctgacactcacctgggcatcagccacttgaatgtggcagccaagcctgagatggcagcactggctggaggtagccggttggcctttgagccacccccgccacgcctctcccacctgcctgtagcctccagtgccagcacagtgctgagtaccaatggcacgggggctatgaatttcaccgtgggtgcaccggcaagcttgaatggccagtgtgagtggcttccccggctccagaatggcatggtgcccagccagtacaacccactacggccgggtgtgacgccgggcacactgagcacacaggcagctggcctccagcatagcatgatggggccactacacagcagcctctccaccaataccttgtccccgattatttaccagggcctgcccaacacacggctggcaacacagcctcacctggtgcagacccagcaggtgcagccacagaacttacagctccagcctcagaacctgcagccaccatcacagccacacctcagtgtgagctcggcagccaatgggcacctgggccggagcttcttgagtggggagcccagtcaggcagatgtacaaccgctgggccccagcagtctgcctgtgcacaccattctgccccaggaaagccaggccctgcccacatcactgccatcctccatggtcccacccatgaccactacccagttcctgacccctccttcccagcacagttactcctcctcccctgtggacaacacccccagccaccagctgcaggtgccagagcaccccttcctcaccccatcccctgagtcccctgaccagtggtccagctcctccccgcattccaacatctctgattggtccgagggcatctccagcccgcccaccaccatgccgtcccagatcacccacattccagaggcatttaaataaacagagatgtgggatgcaggaccccagcttccgttcccaagccctgttgggagtcctttccagtgcttcaggatgctggggcgaccaaaggagccttttaaaaaatgtttttatacaaaataagaggacaagaatttccatttttttttttagtatttatttatgtacttttattttccacagaaacactgcctttttatttatatgtattgttttctatggcactagggaaaaacatatctgttccaagaaaataaactagttctcagagccttgattttcctggtcagggtgaagttccctgtgtgtctgtaaaatatgaacaaggattcatgatttgtaaatgctgtttatttattgattgcttctttccaaaatcgaaaagaaagaaaaaagaacgtgacaggagaagggaagctggaaactgccatggccagaattgcccctcccccacactcactgcccctccccccagcgtcacctgggatttgcagatgtgtttagaaacacgcccagaccttgaaccttgggttcatggattagttttgtatctaaaacaggaaacaagtcagatgatgtggtttgtacactttctgtaaccaccagtgtggacttgaagaagtgtcctcagcatgtgcagagtctactacccagtaccagtcgtgagtctgcaggctccagtgttctgtagtagtgtttatgggccttgggagtacttctcccctgccctgccccactgtccccttcctgacaacttgagccagtaagccatgcagggtgtggtgcctcctagagaaaacactgcctggactgttctgtgcatccctccaaacagcatcatccaaatccaactgaggacagacggactgtcccggcctgggcctgggctcctaacacctgactgccaaagggctccaatgtgcattgtggactcgccagagtagcctgcattgagactccaagaaaacagaagctatgtggcctctgatccccaaactggcctgggtggggacatgccttgagtgtgctggaatgtgggtggagcctgcttctgggccacccctcctggttcagggctgtgctcacagcagattcttgcagtatcaagtatacgcctgtggcagaataagtatctgtaaatacatgtttaaagaggattttgtttaaaaaatctaaaggaacaagtgtgtcgtgtgtcaagctgatgaggactgtcagactgtggcttagctcagtgtgacccagaccttgtgacctgtagctgccgaaccagtagctcctaagagcacaacccaggatggcccatctgctgcccaccaagtccctttccagccactgtgtgctgggggctttcgggggcagttgcccacctcctcagggcagctctttctggccttttggggggcagtgtctgtgccatgcctaatagatatgaccagacgcatcctaagatgttgattcttactgtgttgtataaaataaagtgtagtttacaaaaaaaagaaaaaaaaaaaaaaa

SEQ ID NO: 30 - DNA, 476 bp, Mus musculus
  modified_base (471)..(471): a, c, g, t, unknown or other
agcatccttagtaacccgagcgtggctcaagtggtcatgatttcatccaaaacacaatgtgtaaacttactcagctaacaatgggaaatgtattgcttctgtgcgcagtggacttacgtgcaatttgttcaaaagggaacaagtcattgaggagaaacaaaagcccaatacttagagtcccaattttgtcttatttgccaaaaaaaaagcaaccccccaagagttgatattgttacaatgtacatactgtaaaatatgaaagaatcgatgtatcttactttttcattatttgctaaccaaagctgttcatttttcatacaatccgcagccttttgagtatcaaaggggtaaaccacacccatcagccattctggaagtgcactatttatactggtatccttgctttttttttcccattttcttgctgagatgacatgaattgttaagtttatttttacacagtaaagagtngaaga

SEQ ID NO: 31 - DNA, 318 bp, Mus musculus
ttgagggagggataccgggatgataggtagctctccctagcagtgtgctccccaagtgcacggctgcgcagctcgcccaagatagctttttgtagatttgtgctctatgtgtgagaagaataaagacgcagggttgctgatgtagccctttggtatattgcttgcccggtgtatacacagttccttctctggaactgaagaaaaagtatatactattgtaataattataataataataaagacagatataatgtattcaatttctcagactttaaatgtagtggctttaaataaataattcattttgctatgatggtc

SEQ ID NO: 32 - DNA, 4356 bp, Mus musculus
acagaaagcccaggcacagtggaacagcggtttccaggagctgctggtcccatcttccaaggctctgctcaactcagagcgcttcttccaaagtctacatcttggtggactttgcagaggaaaccgggaggtagagacacgtgaggtcgtgatggaacttgaagaggaccttaagggaagagcagacaagaacttctcaaagatgggcaaaaagagtaaaaaggagaagaaagaaaagaaaccagcagtcagtgtgcttacaatgtttcgttatgcaggttggctggacaggttgtacatgctggtgggaactctggctgctattatccatggagtggcgctcccacttatgatgctgatctttggtgacatgacagatagctttgcaagtgtaggaaacgtctctaaaaacagtactaatatgagtgaggccgataaaagagccatgtttgccaaactggaggaagaaatgaccacgtacgcctactattacaccgggattggtgctggtgtgctcatagttgcctacatccaggtttcattttggtgcctggcagctggaagacagatacacaagatcaggcagaagttttttcatgctataatgaatcaggagataggctggtttgatgtgcatgacgttggggagctcaacacccggctcacagatgatgtttccaaaattaatgaaggaattggtgacaaaatcggaatgttcttccaggcaatggcaacattttttggtggttttataataggatttacccgtggctggaagctaacccttgtgattttggccatcagccctgttcttggactgtcagctggtatttgggcaaagatattgtcttcatttactgataaggaactccatgcttatgcaaaagctggagcagttgctgaagaagtcttagcagccatcagaactgtgattgcgtttggaggacaaaagaaggaacttgaaaggtacaataacaacttggaagaagctaaaaggctggggataaagaaagctatcacggccaacatctccatgggtgcagcttttctccttatctatgcatcatatgctctggcattctggtatgggacttccttggtcatctccaaagaatactctattggacaagtgctcactgtcttcttttccgtgttaattggagcattcagtgttggacaggcatctccaaatattgaagccttcgccaatgcacgaggagcagcttatgaagtcttcaaaataattgataataagcccagtatagacagcttctcaaagagtgggcacaaaccagacaacatacaaggaaatctggaatttaagaatattcacttcagttacccatctcgaaaagaagttcagatcttgaagggcctcaatctgaaggtgaagagcggacagacggtggccctggttggcaacagtggctgtggaaaaagcacaactgtccagctgatgcaaaggctctacgaccccctagatggcatggtcagtatcgacggacaggacatcagaaccatcaatgtgaggtatctgagggagatcattggtgtggtgagtcaggaacctgtgctgtttgccaccacgatcgccgagaacattcgctatggccgagaagatgtcaccatggatgagattgagaaagctgtcaaggaagccaatgcctatgacttcatcatgaaactgccccaccaatttgacaccctggttggtgagagaggggcgcagctgagtgggggacagaaacagagaatcgccattgcccgggccctggtccgcaatcccaagatccttttgttggacgaggccacctcagccctggatacagaaagtgaagctgtggttcaggccgcactggataaggctagagaaggccggaccaccattgtgatagctcatcgcttgtctaccgttcgtaatgctgacgtcattgctggttttgatggtggtgtcattgtggagcaaggaaatcatgatgagctcatgagagaaaagggcatttacttcaaacttgtcatgacacagacagcaggaaatgaaattgaattaggaaatgaagcttgtaaatctaaggatgaaattgataatttagacatgtcttcaaaagattcaggatccagtctaataagaagaagatcaactcgcaaaagcatctgtggaccacatgaccaagacaggaagcttagtaccaaagaggccctggatgaagatgtacctccagcttccttttggcggatcctgaagttgaattcaactgaatggccttattttgtggttggtatattctgtgccataataaatggaggcttacagccagcattctccgtaatattttcaaaagttgtaggggtttttacaaatggtggcccccctgaaacccagcggcagaacagcaacttgttttccttgttgtttctgatccttgggatcatttctttcattacattttttcttcagggcttcacatttggcaaagctggagagatcctcaccaagcgactccgatacatggttttcaaatccatgctgagacaggatgtgagctggtttgatgaccctaaaaacaccaccggagcactgaccaccaggctcgccaacgatgctgctcaagtgaaaggggctacagggtctaggcttgctgtgattttccagaacatagcaaatcttgggacaggaatcatcatatccctaatctatggctggcaactaacacttttactcttagcaattgtacccatcattgcgatagcaggagtggttgaaatgaaaatgttgtctggacaagcactgaaagataagaaggaactagaaggttctggaaagattgctacggaagcaattgaaaacttccgcactgttgtctctttgactcgggagcagaagtttgaaaccatgtatgcccagagcttgcagataccatacagaaatgcgatgaagaaagcacacgtgtttgggatcacgttcttcttcacccaggccatgatgtatttttcttatgctgcttgtttccggttcggtgcctacttggtgacacaacaactcatgacttttgaaaatgttctgttagtattctcagctattgtctttggtgccatggcagtggggcaggtcagttcattcgctcctgactatgcgaaagcaacagtgtcagcatcccacatcatcaggatcattgagaaaacccccgagattgacagctacagcacgcaaggcctaaagccgaatatgttggaaggaaatgtgcaatttagtggattcgtgttcaactatcccacccgacccagcatcccagtgcttcaggggctgagccttgaggtgaagaagggccagacgctggccctggtgggcagcagtggctgcgggaagagcacagtggtccagctgctcgagcgcttctacgaccccatggctggatcagtgtttctagatggcaaagaaataaagcaactgaatgtccagtggctccgagcacagctgggcattgtgtcccaagagcccattctctttgactgcagcatcgcagagaacattgcctacggagacaacagccgggtcgtgtcttatgaggagattgtgagggcagccaaggaggccaacatccaccagttcatcgactcgctacctgataaatacaacaccagagtaggagacaaaggcactcagctgtcgggtgggcagaagcagcgcatcgccatcgcacgcgccctcgtcagacagcctcacattttacttctggacgaagcaacatcagctctggatacagaaagtgaaaaggttgtccaggaagcgctggacaaagccagggaaggccgcacctgcattgtgatcgctcaccgcctgtccaccatccagaacgcggacttgatcgtggtgattcagaacggcaaggtcaaggagcacggcacccaccagcagctgctggcgcagaagggcatctacttctcaatggtcagtgtgcaggctggagcaaagcgctcatgaactgtgaccatgtaagatgttaagtatttttattgtttgtattcatatatggtgtttaatccaagtcaaaaggaaaacacttactaaaatagccagttatctattttctgccacagtggaaagcatttagtttggtttagagtcttcagaggctttgtaattaaaaaaacaaaaatagatacagcatcaaatggagattaatgctttaaaatgcactataaaatttataaaagggttaaaagtgaatgtttgataatatatacttttatttatactttctcatttgtaactataactgatttctgcttaacaaattatgtatgtatcaaaaattactgaaatgtttgtataaagtatatatagtgaaaaaaaaa

SEQ ID NO: 33 - DNA, 6297 bp, Mus musculus
gctgggcttctcggcgcgaccgccggctgcctgagaaagccggcctgtgcttggcctcggcttcccggccgagagtggtgaggcggaggcgggaggcgggaggccccgggggcggggcgggaggcgaagactcatgaaatggccacagatgacaagagttccccgacactggactctgctaatgatttgcctcgctctcctgccagtccttctcacctcactcactttaaacccttgactcctgaccaggatgagccccccttcaagtcagcatatagttcttttgtaaacctttttcgttttaacaaagagcgaggagaagggggccaaggagagcagcagtctccgagttcaagttgggccagccctcagatcccttcaagaacacagtctgtgaggtcgcctgtaccttataaaaaacagcttaatgaggagctccaccggcgctcttcagtgttagagaacactttgccacatcctcaggagagcacagactccagaaggaaagcagaaccagcctgtggaggtcatgacccacgtacagctgttcagcttcgaagcctcagcacagtattgaaacgcctcaaagaaatcatggaaggaaaaagccaggacagtgacctgaagcaatattggatgccagatagccagtgtaaagagtgctatgactgcagtgaaaagtttacaacatttaggcgcagacaccattgcagactgtgtgggcagattttctgcagtcgttgttgtaatcaagaaatccctggaaaatttatgggctatacaggagacctccgagcatgcacctactgtagaaaaatagccttaagttatgctcattctacagacagtaattccattggggaagacttgaatgctctttcagattcaacttgctctgtgtctatacttgatccaagcgaacctcggacaccagttgggagtagaaaagccagtcgtaacatattcttagaggatgatttagcctggcaaagcttgattcatccggattcctcaaatagtgctctttcaacaagactcgtatctgttcaagaggatgctgggaagtctcctgctcgaaacagatcagccagcattactaatctgtcactggatcggtctggttctcctatggttccttcatatgagacatctgtcagtccccaggctaaccgaaactacattaggacagagacgactgaggatgaacgcaaaattcttctggacagtgctcagttaaaggatctgtggaagaaaatctgccatcacaccagtgggatggaatttcaagatcaccgttactggttgagaacacatcccaactgcattgtagggaaggaattagtcaactggctaatcagaaatggacacatcgctacaagggcacaagctatagcaattggacaagcaatggttgatggacgttggttggattgtgttagtcatcatgatcagcttttcagggacgaatatgcgttgtatagaccacttcagagtacagaattttctgagacaccttctccagacagtgactctgtgaactctgtggaaggacactccgagccatcctggtttaaagacataaaatttgatgacagtgacacagaacagattgctgaagaaggtgacgataatttggctaagtatttggtttctgacactggaggacagcagctctcaataagtgatgccttcatcaaagagtccttatttaatcgacgagtagaggaaaaatccaaagagctgccttttacccctttgggctggcatcataacaacctggaactcttgcgagaggagaatgaggagaagcaagccatggaaaggctgctttcagctaatcataaccacatgatggccctactccagcagttgcttcaaaacgagtcattgtcatcgtcttggagggacatcattgtgtcactagtctgccaggttgttcagacagtccgacctgatgtcaagcaccaggatgatgacatggatatccgtcagtttgtccatatcaagaagatcccaggtggaaagaaatttgactctgtggttgtcaatggctttgtttgtaccaagaacattgcacataaaaagatgaattcctgtattaaaaaccccaaaatccttctgttgaagtgttctattgagtatctctatagagaagaaactaagtttacctgcattgatcctattgtgcttcaggaaagggaattcttgaagaattatgttcaacgaatagttgatgttcgacccacattggttcttgttgagaaaacagtgtctcggattgctcaggacatgttactggaacatggcattactctggtcattaatgtaaagtcacaagttttagaaagaatcagtcgaatgacccaaggtgatttagtggtgtccatggaccagctgctcaccaaaccccacttgggcacttgccacaaattttatatgcagatatttcagctgcctaatgaacaaaccaaaacactgatgttttttgaaggttgtccacagcatctaggctgcacaatcaagctcagaggaggctctgattatgagctggctcgagttaaggagatcctaatatttatgatctgtgtagcttatcattctcagctagaaatctcttttctcatggatgagttcgctatgcctccaacattaatgcaaagcccttcattccatcttctgacggagggacgaggtgaagagggagcctctcaggagcaggtcagtggcagctcccttcctcaggatcctgagtgccctcgtgaggccctgtcttctgaggatagcactttgttggaatcaaggactgtgctagagaagggtgaactagacaataaaagtattccacaagctgttgcctctttgaagcatcaagattataccacccccacttgcccagcaggtattccctgtgctctttttgcattggtaccagagtcattgttgcctctccatatggatcaacaggatgccgtaggaaatgaacaccgagagacttcacagcaaacggatgagcaacaggatcccaaaagccagatgaaagcttttagagaccctttacaggatgacactggaatgtacgttactgaggaagtcacctcctctgaagatcaacgaaagacttatgccttgacatttaaacaggagttaaaagatgtaatcctctgtatctctccagttattacattccgtgaacctttccttttaactgaaaaggggatgagatgctcaactcgagattattttccagagcagatttactggtctcctcttctcaacaaagaggtgaaggaaatggagagcaggaggaagaaacagctgctcagggatctctctggacttcagggcatgaatggcagtgttcaggccaagtctattcaagtcttaccctcacatgagctagtgagcaccaggattgctgaacatgtgggtgacagccagaccttgggtagaatgctagctgattatcgagctagaggaggagaattcagtcaaaacatttggaacccctttgtccattcaaaagatgacatcatgtacttcaggtggcaaatcagggaaacaaaactgagagtgatgaaagagaggggattgattccaagtgatgtaatatggccaacaaaggtggactgtctgaaccctgctaaccaccagaggctctgtgtgctcttcagcagctcttctgcccagtccagcaatgctcccagtgcttgtgtcagtccttggattgtaacaatggagttttatggaaagaatgaccttacactggggatatttttagaaagatactgtttcaggtactcttaccagtgtccgagcatgttctgtgacacccccatggttcatcacattcgacgctttgttcatggccaaggctgtgtacagataattctgaaggagttggattctccagtgcctggatatcaacatacaattctcacatattcctggtgcagaatctgcaaacaagtaacaccagttgttgctctttcaaatgaatcctggtctatgtcatttgcaaagtaccttgaacttcgattttatggccaccagtacacacgcagagccaacgctgagccctgcggtcactctatccaccatgattatcaccagtatttctcttataaccagatggtggcatctttcagttactctcctattcggcttcttgaagtatgtgttccactaccaaaaatattcattaagcgtcaagccccactgaaggtatctcttcttcaggacctcaaagacttttttcagaaggtttcacaggtgtacctagctgttgatgagagacttgcatccttgaaaacggatacatttagcaaaactagagaggaaaagatggaagatatctttgcacaaaaggagatggaagagggtgagtttaagaactggacagagaagatgcaagcaaggctcatgtcttcctctgtggatacccctcagcaactgcagtccatttttgagtcactgattgccaagaagcaaagcctctgtgaggtgctccaggcgtggaacagcaggttgcaggacctcttccagcaggaaaaaggtagaaagaggccttcagttcctcccagtcctgggagactgagacaaggtgaagaaagcaagataaatgcaatggacacatctccaaggaatatttctccaggactttcacaatggagaaaaagaagatcgcttcttgacaaccctgtccagccagctacgagctccacccacctccagctgcccactcctcccgaggccctggccgagcaggtagtgggagggccgactgatctggattcagccagtggctctgaagatgtatttgatggtcatttgctgggatccacagacagccaggtgaaggaaaagtcaaccatgaaagccatctttgctaatttgcttccaggaaacagctacaatcccattccatttccttttgatccagataaacactacttaatgtatgaacatgaacgggtgcccattgctgtctgtgagaaagagcccagctccatcattgcttttgcactcagttgtaaagaataccgcaatgccttagaggaattgtccaaagcaactctgcggaacagtgctgaagaagggctcccagccaatagtgctttagataacagacctaagagtagcagccctattagactacctgaaatcagtggaggacagacaaaccgcacagtagaagcagaacctcagccaaccaaaaaagcttcaggaatgttgtccttcttcagaggaacagcagggaagagccctgatctgtcttcccagaagagggagaccttgcgaggggcagacagtgcttactaccaggttgggcaggccggcaaggaggggttggagagtcaaggcctggagcctcaagatgaagtagatggaggagatacacagaagaaacaactcacaaatcctcatgtggaacttcaattttctgatgctaatgccaagttttactgtcggctgtactacgcgggagagttccacaagatgcgtgaagtgattctgggcagcagtgaggaggaattcatccgttccctttctcactcatctccctggcaggcccggggaggcaagtcaggagctgctttctatgccaccgaagatgatagattcattctgaagcaaatgcctcgtttggaagtccagtctttccttgactttgcaccacactacttcaattatatcacaaatgctgttcaacaaaagaggcccaccgccttggctaaaattcttggagtttacagaattggttataagaactctcagaacaacactgagaagaagttagatctccttgtcatggaaaatcttttctatgggagaaagatggcacaggtttttgatttgaagggttcacttaggaatcgaaatgtaaaaactgacactgggaaagagagctgtgatgtggttctgttggatgaaaacctcctaaagatggttcgagacaaccctctctatattcgttcccattccaaatctgagctgagaacctccatccacagcgacgcccatttcctttccagccacctcattatagactattctctgctggttgggcgagatgacactagcaatgagcttgtggttggcatcatagattacattcgaacatttacatgggacaaaaaacttgagatggttgtgaagtcaacaggaattttaggaggacaaggtaaaatgccaactgtggtctctccagagttgtataggactagattttgtgaagcaatggacaagtatttcttgatggtgccagaccactggacagggttggatctgaattgctga

SEQ ID NO: 34 - DNA, 3326 bp, Mus musculus
ttgggccagtggcctgtcactgggttctccgctcttatgttggaaagtgtgagggacacaggagcgacctgcatacctgagcctccgagagagaagctgcactctggcatccagtagcagcaggagactaagcagataaaaggagccatgacttctggcgctagtcatatgctggaagctgccctggagcagatggacgggatcattgcaggcactaaaacagctgcagattttagtgatggtacctgtgagcctgggctgtctcccccatccacctgcttgaactccatgcctgtgctccatctcattgaggacctgagactagccttggagatgttggcacttcctcaggaaagagaagccctcctgagccaggtccctggcccaacagctacctacataaaggagtggtttgaggacagcttgtcccaggtaaatcaccacggtgctgctagtaatgaaacctaccaggaacgcctggcacggctagaaggagataaagagtccctcatactacaggtgagcgtcctcacagatcaagtggaagcccaaggagagaagattcgggaccttgaagtgtgtctggaaggccaccaggtgaagctcaatgctgcagaagagatgcttcagcaggagctgctaagtcgcacatctctggagacccagaagttggatctgatgactgaggtgtctgagctgaagctcaagctggttggtatggaaaaagaacagaaagaacaagaagaaaaacagagaaaagcagaggagttactgcaagagcttaagcacctcaaaatcaaggtggaggagctggagaacgagcggaaccagtatgagtgggagctgaaggccaccaaggctgaggtagcccagctgcaagaacaggtggccctaaaagatgcagaaattgagcgtctccacagccagctctcccggagtgcagctctccacagcgaccatgcagagcgagatcaagaaatccaccgtctgaaaatggggatggaaacactgctggttgccaatgaggataaggaccgtcggatagaggagctgacagggctgttgaacaagtacctaagggtaaaggagattgtgatggcaactcaggggccttcagaaagaaccctctccatcaatgaagatgaaatagagggaagcttccgaaaatggaataccacaaataaaagcccagaggaagtcccgaagcaagagatatcaccacgatgcagctctcccaccccaggaccacctcctttgccacagaaatcactggagagcagggctcagaagaaactctcctgcagtctagaagacttgagacgtgaatctggggataagtgtgtcgatgggaaccagctgtccccagtgggagagcccaaggacagctctttcctagcggagcagaaataccccacattacctgggaagctttcaggagccacacccaatggagaagctgccaaatctcctcccactgcctccctccagcctgactcttcagggagcagccagccaaagctgaatcgcggctggagtgtcagtgctcccgtattaggagacacagaaggaggctgggaagatatagtctcatctgcttcgtctgggactgagtcaagccctcagtctcccgtgacaccagatggcaaacggagccccaaaggcattaagaagttctggggaaagatccgaagaactcagtctggaaacttcaatactgatgcaccggggatggcagagtttcgacgaggtgggctccgagcaactgcgggaccaaggctttctaggaccagggacaccaagggacagaaatgtgatgccaatgccccctttgcccagtggagcacagaacgcgtatgtacatggatggaggatttcggcctgggtcagtatgtgatctttgccagacagtgggtgacatctggacatacactactgacagctacccctcaggacatggaaaaggagctagggattaaacaccccctccacaggaagaagctggttttagcagtgaaagctatcaacgccaagcaagaagaaacgtctgcgctgctggaccacatttgggtgacacggtggcttgatgatattggcttaccccaatacaaagaccagtttcatgaatcaagagttgatgggcgaatgctgcaatacctaactgtgaatgatctactcttcttaaaagtcaccagccaactacatcatctcagcatcaaatgtgctattcacgtgctacatgtcaacaagttcaaccccaactgcctgcacaggaggcctgctgatgagagtaacctttccccttccgaagttgtgcagtggtccaaccacagggtaatggagtggctgcgatccgtggacctggcagagtatgcacccaaccttcgagggagtggcgtccatggcggcctcattatcctggagcctcgctttactggggacaccctggctatgcttcttaacatccccccacagaagacgctcctcaggcgccatctgaccaccaagttcaacgccctgattggtcctgaggctgaacaggaaaagcgagacaaaatggcctcacccgcctacacacctctgaccaccaccgccaaagttcggcctaggaaacttggattttcacattttggaaacatgagaaaaaagaagtttgatgaatctacagattacatttgccccatggagcctggagatgctgtcagtgacagccacagggtctacggagtctaccggggcctcagtccccttgacaaccatgaactagatggtttggaccaggtgggacagataagctgatgaccctgttatctgccttctctgtgcacggagagctcacagtaacactgtgtgtcaccacgtaactgcacttcaccctcgtccttttgcatgatctacagaaaacaattgtgtctttgggctggtctcactacacactttaaggatggtcagaatatgcagttatacagccacaaaggggacagactttggggaactatagccaaatgtggactctgggaaaacacctgcagacattagtagatgtttagtaattcatagtatccatgtttcagcttgaaacacatgagcagagggcaggccctgggtaatcgcaaaaggttcagttctcagacgctgcccctattcttcagtcgagggaagaattcaagtgccttaggtttgtgagccacaaagtcttggctgagatcaaagtgccaacagcggatgtttggaccatagtgacaatgtaatttgattgtaccttactatagagtggccacttgtttctgataataaaaacaatatttatgtaaaaaaaaaaaaaaaaa

SEQ ID NO: 35 - DNA, 550 bp, Mus musculus
gtatctggtaactccatgttcatgaaaagtatataaatatattacaggaaattatatatagtaaacattagaaatggatacagtaaacattgctagttcgtcttctatgccaatattactgtcattaaaagcttaaatactggcttcaagtatcccctataaaataaatctactttattaaaatactggaaaatttttgctataaacaggatttggtacattaaaaatagactcagtgtgtctttgtaacaacgtccactatgatcaaatgctgtctccagccctaagacctgctggttcagttagtgaaaaaggagttttaatgaccatcagtggttgaagtggctgtaaaaacacagcatcttgacgtccgtatctgacgggaacgcctgtccttcaagcaggagggactaagcttcacggtgctgcttgcttggccttgctgctctcaagagtggagagcaggagtcggctggatgcaggaagggagggagcctttggaggctgctctgcatcactgtgggagccctggctgtgccttctgctcttc

SEQ ID NO: 36 - DNA, 606 bp, Mus musculus
atggagtgggtgtgggcgctcgtgctgctggcggctctgggaggcggcagcgccgagcgcgactgcagggtgagcagcttccgagtcaaggagaacttcgacaaggctcgtttctctgggctctggtatgccatcgccaaaaaggaccccgagggtctctttttgcaagacaacatcatcgctgagttttctgtggacgagaagggtcatatgagcgccacagccaagggacgagtccgtcttctgagcaactgggaagtgtgtgcagacatggtgggcactttcacagacactgaagatcctgccaagttcaagatgaagtactggggtgtagcctcctttctccagcgaggaaacgatgaccactggatcatcgacacggactacgacaccttcgctctgcagtactcctgccgcctgcagaatctggatggcacctgtgcagacagctactcctttgtgttttctcgtgaccccaatggcctgagcccagagacacggaggctggtgaggcaacggcaggaggagctgtgcctagagaggcagtacagatggatcgaacacaatggttactgtcaaagcaggccctccagaaacagtttgtag

SEQ ID NO: 37 - DNA, 1762 bp, Mus musculus
gccatggcggcggtggcggtggcagcaagggttgcggcgtgagtggcagctgcggaccgagcggaccagggcagcggagccccggggttcctggggagaggcccgcagcagggcagcgcgaaggccggagctggacctctctcagcggagccccgcttggagggggagggtctatgccccgtcaccatgacgacgccggcgaatgcacagaatgccagcaaaacgtgggaactgagtctctatgagctgcaccggaccccgcaggaagccatcatggatggtacagagattgcggtttcgcctcggtcactgcattctgagctcatgtgtcccatctgcctggacatgctgaagaacacaatgaccaccaaggagtgcctgcataggctctgctcggactgcatcgtcaccgccctgcggagcgggaacaaggagtgccctacctgccggaaaaagctggtatccaagcggtccctacggccggaccccaacttcgacgccctgatctccaaaatctaccctagccgggaggaatatgaggcccatcaggaccgggtgctcatccgcctcagccgcctgcacaaccagcaggcgctgagctccagtatcgaggaagggctccggatgcaggccatgcacagggcccagcgtgtgaggcggccgatgcctggatctgatcagaccgccacaatgagtgggggggaaggagaacctggggagggagaaggggatggagaggatgtaagctctgactccgccccagactctgctccaggccctgctcccaagcgaccccgcggagcgggtgcaggggccagcagtgtagggacagggggtggggctgctggtggggcttgcgggggtgccggttctgaagactctggtgaccggggcggcaccctgggagggggaaccctggggcccccaagccctcctggggcccccagccctccagagcccggtggagagattgagcttgtgttccggccccatcccctgcttgtggagaaaggagagtactgccagactcggtacgtgaagactactgggaatgccacagtggatcatctctccaagtacctggccctgcgcattgccctggagaggaggcagcagcaggaaaccgcagagcccggagggcctggtgggggtgcttcggacacaggcggacctgatgggggtggtggggagagaggcgttgccggaggaggcgaaggtcctgaggagcctgcgctccccagcctggaaggtgtcagcgaaaagcagtacaccatctacatcgctcctgggggcggagcgttcacgacgctgaatggatcactgaccttggagcttgtaaacgagaagttctggaaggtgtccaggcccttagagctctgctatgcccccacgaaggacccaaaatgatgtcacaaggggacagctggaacatggggaccacagggtgtctctgtgtcccagctcagcctgccagcttcatctcctaaagccccccagccagacagcaagaggacaaaggaggacaaatggcttttatacaaagtatctatattgaattagtctatattggacagcacgggccctgtacccactactgccttttctatagaccctaggttcccaccctgctggtgataggcagggtggacaagaccccctccccgccctcctcccaacaacaaatttgcttatttcttctttgaaaaaaaaaaaaaaaaaaaaaaaaaaaaaaaaaaaaaaaaaaaaaaaaaaaaaaaaaaaa

SEQ ID NO: 38 - DNA, 1774 bp, Mus musculus
cgaggaacacttgctgccgagaacattggctggatacctctagatctaccctttaagacttgagaactaggttgggaccatggggacaacgaaggtgaccccatctctggtgttcgccgtgactgttgccacgatcggctctttccagtttggctacaacactggagtcatcaatgcacctgagacaatcctaaaggactttcttaactacactttggaagagcggttagaagacctaccaagtgagggactgctgactgccctctggtccttatgtgtggccatcttctctgttggtggcatgattggctctttttctgttggactctttgtcaaccgctttggcagacgcaactctatgcttctagtcaacttgctggccatcattgcgggctgccttatgggattcgccaagatagcggagtctgttgaaatgctgatcctgggccgcttactcattggcattttctgtggcctgtgcacgggctttgtgcctatgtacattggagaggtgtctcccactgcccttcggggtgcatttggcacactaaaccagctgggcatcgttgttgggattctggtagctcagatctttggtttggactttattctgggctctgaagaactgtggcctgggctccttggcttaaccatcattccagctatcctgcaaagcgcagcccttccattttgccctgagagtccaagattcttgctcattaacaaaaaggaggaagaccaagctacagagatcctgcagcgcttgtggggcacctcggacgtggtccaggagatccaggagatgaaggatgagagtgttcggatgtcacaggagaagcaggtgactgtgctggagctcttcaggtcacccaactacgtccagccgcttctcatctccattgtcctccagctgtctcagcagctctctgggatcaatgctgtgttctattactcaacaggaatcttcaaggacgcgggtgtccaggaaccgatctatgccacgattggagcaggcgtggtcaatactatcttcactgtagtttctctgttcctggtggagagggcagggaggagaaccctgcatatgataggcctgggaggcatggctgtttgctccgttttcatgacgatttcgctgttactaaaggatgactatgaagccatgagttttgtctgtattgtggctatcttgatctacgtagccttctttgagattggacctggccccattccctggtttattgtggctgagctcttcagccagggcccccgcccagctgccattgcggtggctggctgttgtaactggacctccaactttctggtcggaatgctcttcccctcagctgcagcctacttaggagcctacgtttttatcatcttcgctgccttcctcatcttcttcctaatcttcaccttcttcaaagtcccggagaccaaaggcaggactttcgaggacattgcccgggccttcgaggggcaggcgcactctggaaaaggccctgccggtgtggagttgaacagcatgcagccggtcaaggagacccctggcaacgcctgagccgggagcacctccttcacctccctccactgtggaaagccacctccccttaagtggggagacctcatcaggatgaaccaggactgcttctgagtgctgctattctcaccccacacactccatgaaaactcagctgcacccaatgctggggttgaccagatcgccaatggcttttaagtgtttgatttggggatacttccttgtaatcaggaa

SEQ ID NO: 39 - DNA, 2281 bp, Mus musculus
atcgaggaagctgagtgtgcctggggcagaggacacgtctctaagggttctttgcagtctagactaacctcagactcactatgtattgaggctggccttgaactccagatctttcagcctccacacccataacgctgagttttaatgaccatgtctagccctaaacttcgcagatttccagctgcacaggctgttaagaggcggaacccagggtcctgtgtttgctaggcaccctctgccttttctgctcctccgtgtcaacagctgctgaagtcacacccccattctctaactaccacccctcaccccagtgtgctgctagccccctcctccctgcacttgcccagaggtctcccggacagagggcaatgcgagcaagctggtgaaggtcttccttctcttcgccatggtcaacagcaccaagtatgaagtggctgctcagcacgaggccgacgatggctctgctctcggggatggggccagcccagtggcggagcaggtcaaactgaagaaggagatctccctgcttaatggcgtgtgtctcatagtggggaacatgatcggctccggcatctttgtctcccctaagggtgtgctcatgtacagtgcctcttttggcctctcactggtcatctgggctgtcgggggcattttctccgtctttggggccctttgttacgctgaactgggtaccaccattaagaaatccggggccagctatgcttatatcctggaggccttcgggggattccttgcgttcatccgcctctggacttctctgctcatcattgaacccaccagccaggccgtcattgccatcacctttgccaactacatggtgcagcccctcttcccgagctgtggcgctccctatgccgccggccgcctgctggccgctgcctgcatctgtctcttaaccttcattaactgtgcctatgtcaagtggggaaccctggtccaagatattttcacctatgctaaggtgttggcgctgattgcagtcatcattgcaggcattgttagacttggccagggagccacagctaactttgagaactcctttgagggctcatcctttgcaatgggtgacattgctctggcactctactcagccctgttctcctactcgggctgggacacccttaactatgtcaccgaagagatcaggaaccccgagaggaacttgcccctctccattggcatttccatgccaatcgtcaccatcatctacctcttgaccaatgtggcctattacagtgtgctagacataaaggaaatcctggccagtgacgctgttgccgtgacctttgcagatcaaatttttggagtattcaattggataattccagtagcggttgcattctcttgctttggtgggctcaacgcctccatcgtggctgcttccaggcttttatttgtgggctcgagagaaggccacctccctgacgccatctgtatggttcatgttgaacggttcacaccagtgccttctctactcttcaatggtgtgttgtccctggtctacctgtgcgtggaggacatcttccagctcattaactactatagcttcagctactggttctttgtgggcctttctattgtgggtcagctttatctacgctggaaggaccccgaccggcctcgccctctcaagctcagccttttcttccccatcatcttctgcctctgcaccatcttcctggtggctgttccactttacagcgacaccatcaactccctcatcggcattggcattgcactctcaggcctgcccttctacttcttcatcatcagagtgccagagcacaaacgaccactgttcctccgcaggattgtagcctctatcacacggtacctccagatcctctgtatgtcagttgctgcagaaatggacttggaagatggagagttgtccaaacaagatcccaagtctaaatagagcaagggattctgaggtgtggacagaacgggtgtttcgtatctcccattggccagaaccctggaggcacggtccaggagcccaagcttggcagcttcaactctgaacttgcttttgagggatgaagagtaatttatttgttttgctacatgtttcagacttcataaatggatgatgcagactgtggcaggaagtaggccattttggggcagtcctggcagcacctgggtgtggccacccactcctctttcctttacaagggccaacaatgctccaaacttgtctccttcagaggaacacaaaactgtcacagatgcaaaacaataaaaaagttatgttcct

SEQ ID NO: 40 - DNA, 4102 bp, Mus musculus
aaaacccatacacatgatgtctgtgggccgagctattgtctgcgtttcctttttcgcgtgggtgtgagccagattggcaagcacagtgtgaatgaaccagcatgaacggagccactcgcttgctgatgtctctctgatgtgttttcccccccagctccggaagagaaggaagtcattaaaggactgtatagcaagctgacggatgcctatggctgcctcggggagctgaggttacaatccggtggcgtccccttgagctttctggtgttggtgacaggctgcatgtcagtgggcagaattccagatgcagagatctacaaaatcactgccactgagttgtaccccctgcaggaagaggccaaggaagaggaccgcctgcccaccttaaagaaaatcctgagctcaggggtgttctatttcgcatggcccaatgatggcgcctgcttcgatctgaccatcagggctcagaaacagggtgatgacggctctgaatgggggacctctttcttctggaaccagctattgcatgtgcctctgcggcagcaccaggtgaactgtcataactggttgctgaaagtcatctgtggggtggtgaccatccgcacagtatatgcctcccacaagcaggccaaggcctgtctcatctctcgcatcagctgtgaacgcgcaggtgctcgcttcctcacccgtggtgtgaacgatgatggccacgtgtccaactttgtggagacagagcagacgatttacatggatgatggagtatcgtcctttgtccagatccgaggctccgttccgctgttctgggagcaaccaagacttcaggttggctcccatcatctgagactgcacagaggcctaggggccaacgctcctgcttttgaaaggcacatggtgcttctgaaggagcaatacggtaagcaggtggttgtgaacctgccgggtagcagaggcggtgaagaggtgctcaacagagccttcaagaagttgctctgggcttcttgccacgcgggtgacacacctatgataaattttgacttccatcagtttgccaaaggtaggaagctagagaaattggagaacctgttgagacctcagttacagctacactgggaagacttcggcgtgtttgcgaagggcgagaatgtaagtccacggtttcagaaaggcactctgcggatgaactgtctcgactgtctggatagaaccaacactgtgcagtgcttcattgctcttgaggtccttcatctgcagcttgagagcttggggctaaattcaaagcccatcattgaccgttttgtggagtccttcaaagccatgtggtctctgaatgggcacagcctgagcaaggtgttcacagggagcagggccctggaaggaaaggccaaggtgggaaagctgaaggatggggcccgatccatgtctcgcaccatccagtccaacttcttcgacggggtgaagcaggaggccatcaagctactgctagtcggagatgtctacaatgaagagtctacagacaaaggacggatgctgctggacaacacggcccttctggcgacccccaggatcttgaaggccatgacagaacgccagtcggaattcacgaatttcaagcgcatccagattgctgtggggacctggaatgtgaacggaggaaagcaattccgtagcaatctcctggggacggctgagctcacggactggctcctagatgctcctcagctgtcaggagcagtggactcccaggatgatggcagtcctgctgacgtatttgccatcgggtttgaggagatggtggaactgagtgcgggaaatattgtcaatgccagcaccaccaacaggaagatgtggggcgagcagcttcagaaagccatctcccgctcccatcggtacatcctcttgacctccgcacagctggtgggcgtctgtctttacatctttgtacgtccgtaccacgtcccgttcatcagagacgtggccatcgacaccgtgaagaccggcatggggggaaaggcggggaataagggtgctgtgggcatccgcttccagctccacagcaccagtttctgcttcgtctgtagccacctgacggctgggcagtctcaggtgaaggagaggaatgaagactaccgggagatcacgcacaaactctccttcccttcggggagaaacatattttcacatgattacgtgttttggtgtggcgatttcaactaccgtattgatcttacttacgaagaagtcttctattttgttaaacgccaagactggaagaaacttatggaatttgatcagttacagttacagaaatcaagtggaaaaatttttaaagactttcatgaaggagccgttaacttcggacccacctacaagtatgacgttggatcagctgcctacgacacaagtgacaagtgccgtaccccagcctggacagacagggtgctgtggtggaggaagaagcatccatatgataagacagctggtgaactcaaccttctagacagcgatctagacggcgatccccaaatcagacacacctggtctccaggcactctgaaatactacggccgtgcagagctgcaggcgtctgatcacagacctgtgctggccattgtggaggtggaggttcaagaggtggatgtaggagcccgggagagggtcttccaggaagtgtcctctgtccaaggcccgctggatgccaccgttgttgtaaacctccagtctccaaccctagaagagaaaaatgaatttccagaggacctgcgcacagaacttatgcagactttggggaattatgggacgattattctagtcaggatcaaccaagggcagatgctggtgacgtttgcagacagccactcggctctcagtgtgctggatgtggatggtatgaaggtgaaaggcagggccgtgaagattcgaccaaagaccaaagattggctagaaggcctgagagaggagcttctccggaagcgagacagcatggcccctgtgtctcccaccgccaactcctgcttgttggaggagaactttgacttctcgagtctggactatgagtccgaaggggatgttcttgaagaggatgaagactatttagtggatgggtttggccagcctgtagtctcagacagtgagctcggtggagacaactcttccgacaccatgagctccttgacacccgccagcaagtctcccgccctggctaaaaagaagcaacatccaacatacaaagacgacgctcacctggtgaccttaaagcaggagctggaagttgctgggaattttcgccaccgttctccgagcaggtccctgtccgttcccaataggcctcggccacctcacccaccacagagacccccccctccaactggcttaatggtgaagaagtcagcctcagacgcgtccatctcttctggcactcatggacaatattccatcttgcagacagcgaaacttctcccaggagcaccccagcaaccacccaaggctagaactggaataagtaaaccttacaacgtcaaacagatcaaaaccaccaacgctcaggaggcagaagcagctatccggtgtctcctggaagctagcggaggggtcccggaatcagccccaggtgccatacccctgagaaaccaagggtcttctaagccagaggccaccctggggcccccagccctgccccgccggcctgctccaagggttcccactatgaagaaaccaactttgaggaggacaggaaaggtgtactcgggcatctcccagtgcttgcgtgaagagctgcgctctgctgcctgcaccccacacgcagtgagtgcacaggactgcggagaccttaacaacagatggagaatgccacgtttctcgcactatattcacacaaaaaaatggaagaacgtatctctcagttttcaagatctctggctaaagtttcgcagatgaactgtagagtacgttggtacaaaaacgcatcctttgtcttcggcttgcaaatgttcaagtggttgacgtccacaggaattagatccccaatgcctaaatctgaagaaagcagaagtgtcaataaaacaaagggaagccaaaaaaaaaaaaaaaaaaaaaaaaaaaaaaa

SEQ ID NO: 41 - DNA, 253 bp, Mus musculus
  modified_base (46)..(46): a, c, g, t, unknown or other
  modified_base (250)..(250): a, c, g, t, unknown or other
  modified_base (253)..(253): a, c, g, t, unknown or other
attcggatccaacgtacggggacgcagggccgggacgccgggctgntgtagagaagcgagcgcgctcgatgtaagcttgccgtccccgccacccctgagccagagcagcgagctcccggacccgcccgaggctccgtcgcgtgtccggcggtggcgacgtcttgcaccccgtcgcctcgccgctcccgacccacccgcgcccccgcccgctgccccttctcccccgcccagccgcggctcggcggcacgnctn

SEQ ID NO: 42 - DNA, 1096 bp, Mus musculus
atgagtgccatggaggagtcacagtcggatatcagcctcgagctccctctgagccaggagacattttcaggcttatggaaactacttcctccagaagatatcctgtcatcacctcactgcatggacgatctgttgctgccccaggatgttgaggagttttttgaaggcccaagtgaagccctccgagtgtcaggagctcctgcagcacaggaccctgtcaccgagacccctgggccagtggcccctgccccagccactccatggcccctgtcatcttttgtcccttctcaaaaaacttaccagggcaactatggcttccacctgggcttcctgcagtctgggacagccaagtctgttatgtgcacgtactctcctcccctcaataagctattctgccagctggcgaagacgtgccctgtgcagttgtgggtcagcgccacacctccagctgggagccgtgtccgcgccatggccatctacaagaagtcacagcacatgacggaggtcgtgagacgctgcccccaccatgagcgctgctccgatggtgatggcctggctcctccccagcatcttatccgggtggaaggaaatttgtatcccgagcatctggaagacaggcagacttttcgccacagcgtggtggtaccttatgagccacccgaggccggctctgagtataccaccatccactacaagtacatgtgtaatagctcctgcatggggggcatgaaccgccgacctatccttaccatcatcacactggaagactccagtgggaaccttctgggacgggacagctttgaggttcgtgtttgtgcctgccctgggagagaccgccgtacagaagaagaaaatttccgcaaaaaggaagtcctttgccctgaactgcccccagggagcgcaaagagagatccgcgggcgtaaacgcttcgagatgttccgggagctgaatgaggccttagagttaaaggatgcccatgctacagaggagtctggagacagcagggctcactccagctacctgaagaccaagaagggccagtctacttcccgccataaaaaaacaatggtcaagaaagtggggcctgactcagac

SEQ ID NO: 43 - DNA, 814 bp, Mus musculus
atgactttctgtcaccatgagtgcacttctgatcctagcccttgtgggagctgctgttgctttccctgtggatgatgatgacaagattgttggaggatacacctgccgagagagttctgtcccctatcaggtgtccctaaatgctggctaccacttctgtggaggttccctcatcaatgaccagtgggtggtgtctgcagctcactgctacaaataccgcatccaagtgagactgggagagcacaacatcaatgtcctggagggcaatgagcagtttgttgattctgccaagatcatccggcaccccaattataattcatggaccctggacaatgacatcatgctgatcaaactggcttcccctgtgaccctcaatgccagagtggcctctgtacctctgcccagctcctgtgcacctgcaggcactcagtgcctcatctctggctggggcaacaccctcagcaatggtgtgaacaacccagacctgctccagtgtgttgatgccccagtgctgcctcaggctgactgtgaggcctcctaccctggggacatcaccaacaacatgatctgtgttggcttcctggagggaggcaaagattcctgccagggtgactctggtggccctgtggtctgcaatggagagctgcagggcattgtctcctggggctatggctgtgcccagccagatgctcctggtgtatacaccaaggtctgcaactacgtggactggattcagaacacaattgctgacaactagagaaccctagtctctcttcaatcagtattatcaataaagttcatttgtcatcactgt

SEQ ID NO: 44 - DNA, 994 bp, Mus musculus
cccacgcgtccgtccatctcggcgtatggtgaaggtgtcactgggttctgcagcactggagtttccatgaccgctcccacatcaccccaccctcgactctggcaccagtatggttctatgcatgttgcagctctctgggctgtgactctgttaagaaggtttgccagctttctggcccttccccgctcctagttactagatgaccatactcatacttgcaaaggagaggagagagtgctaaagcctggttctgactgagggctctgcgtccctgcacgtaaacaggtgagatctgcagcagggcagggctgctttaacaggcaggggtggcagtaagtcacagctgctgctgctgtcgtctgcccgccattcagctaaccgttctgttgaggtcctgccttgtgctttcctagtggaagccgtcctttgcccccgttgatgacttgagcccttgccaaacaaacaccgatgagtgaagtggctgcaacttggcagccccaaaacctgccacacccctgcacccctggaagcccagcaccggggccagcaggctgtgtaccgtgcttgccaacctagaccctggccaattagaaacttgttccgtccacgcagctctctgccctcctcgagagcacgatgagcagcctcaactgacgtctctattcaatgacgttatcacgaagttcgcaacatctcctccaagcactaatgtgtcctgtccacttccaacgctgttcctaatttgccaaccggctgctctaggctccttgaggagtgtcccttctccaaaggaactgcgccctggaaagggctccccgaaacttctacgtggccctgaccctgacacttgccttttctcggcacttcctttggggtggctgagcattcttgaccagaccctcttgccgtctctagttccacggggccacgttctggcgtctggcttggctttcagccggctttgacccttgggctcagcgctcccaagtctggc

SEQ ID NO: 45 - DNA, 646 bp, Mus musculus
tgaaagtgatccaggaccaagtggccagggttaaggcacggaacagcggagcctcgaccctgaatgtcagatccaactctattacagtggtccgttcaagagaaaagatctcctgtccctattgtcacataacgtttaccatgagaacctgtctcttaacccacctcaagatccacttcagacgtcaacccaaccagcacttctgctgcaaagagtcggcccactcatccaacacactcagaatgcaaaagatctacacttgccccgtctgtgacagctcctttaggggaaaggagagcctgctggatcacttgtgctgccaaagaccaatcagattcagtaaatgctgggaaatcctgggtcatttgctcggctatcttcatgaacccgtggtgctgggaaatatttttaaagtaagggactcctcgggaaagaggatggaatccaggaggagaagacggaaacgtgcctgcactgagaatcctgaaacagaaggcctgtctgggaaaggtagggtggctccgtgggaaatggagggtgccactagccctgagagtcctgtgacagaagaagattcggactgatttctgacttcacacctacccatgcacgacaccccccaccccacaaaataaatacaattttt

SEQ ID NO: 46 - DNA, 1670 bp, Mus musculus
ccacgcgtccgggtggcactacacagggacagctaacagtgcatcccgagtgactggctttctgaatcctgctccacgcgaccagcagagacatgaattactcacggttcctcactgcaacgagcctggccagaaagccatctcccatcagaactacagcggacatactgagcaaagcaccaaaaaccctcatctccctggctcctggatctccaaacccgagcatgttcccctttaagtcagctgccttcactgtggaaaacggaagcaccatccggtttgaagacgacttgatcaaaagggccctccaatactctccaagctatggaattccagaacttctgtcctggctaaaacagtttcaagtaaaattgcataatccccccactgtcaactacccacccaatcaaggacagatggatctctgcatcacatctggctgccaagatggtctctgtaaggcatttgaaatgctcatcaatcctggagacactatcctggtcaatgaaccactgtttccaggaaccctttatgctatgaaaccactaggctgcaacattattaatgtccccagtgatgagcatgggattattccagagggtctcaaaaaaatcctttcccagtggaaaccagaagattccaaggatcccacaaaaaagactccaaaatttctgtatactgtcccaaatggcaacaaccctacaggcaactcgttgacaggtgaccgcaagaaggaaatctatgagcttgcaagaaaatatgatttcctcataatagaagatgacccttactattttcttcagtttagcaagccttgggagccaacttttctctccatggatgttgatgggagagtcatcagagctgacaccttttcaaaaaccgtctcctcagggttgagagtagggtttatgactggccctaagaccttgatacagaatattgttctccacacacaagtctcatcagtacatgcctgtactctctcacagctcatgatactacagcttctacaccaatggggagaagagggtttcctggctcatattgacagaactattgatttctacaagaaccagagggattccatattggcagctgcagacaagtggttacgtggcttggcagagtggcatgttcccaaagctggcatgtttctatggattaaagttaagggaatctccgatacaaaacaactgattgaagaaaaggctattgaaagagaggtcttacttgttcctggaaatggtttcttcattgatggctcagctcctacctccttcttcagagcatccttctctctggctactccagcacagatggatacagccttccagagattggcccaactgataaaagagtctttatgaagaaatcaaactcagcattggactcataatttttaaataaattacttctgtactttgcagaagaaatggttgttgctgtttgactgacaggatggatccaggttgtgaaacatctgtagcaatttccctgaaccactttaaagtccccttaaatccatcacattgccaaatagctttctgatctacttttgccctttgattaatttgcaactgacaaagcattaaattttattgtaaagagctctatagctgctttataatagccaataaatttttttcaaaactaaaaaaaaaaaaaaa

SEQ ID NO: 47 - DNA, 1200 bp, Mus musculus
aaacagacttgtgcccgtcaactgcatcttcccagaccggtgtgggaacaacggccaggtccacgtcctgtgtggcgtgccgatgacagccgcgaggtttccttccctaagcggtcgcgggcgggcaagaggcaaagtttgtcggagaatcggggtgactttgctcggggacccgcatctgcgcgaatgcgcggtgccgcggaggccgtctcgcagcagctccgggctggggaccggctgtccctcgctcccggaaccccttcaggggtgtgttctggaaaagtggcgacatgagctagagctggagcagcaggagggagcaactcgcacccctgcagcccaggcggggagggcgcggaccccgtggtgctgccctgcggccgagatgagggaacagccctcgtttgcctggcgctgatactcgaggctgtggcggtagtggaatgcaaaagccaagactaatggaaacagggcctaaagacccctgcaggatgcctgaggcaagttcacccaggcgaactccacagaatgttccctaccaggacctgcctcacctggtcaatgcagacggacagtacctcttttgtagatactggaagcccagtggcacacccaaggccctcatctttgtgtcccatggagctggggaacactgtggccgttatgatgagctggctcatatgttgaaggggctggacatgctggtatttgcccatgaccatgctgtgatgctctctgctgctctgcagtcagccctggttatatttgtgagacttatttggcagataatattccagggttatccccgaggcgtttgctgtgggggacgctgtcattattaagcccaacgctctgcacactagaaaatcctgagacaagaatgttttgtcctgttgcatccgtctccattaaaatccattgtcgttgtcgtggtgtgctggcgaccccttgaattgttgcagcgagcaccctgaatctcgggacctgtcttacagctcagcgtcagccgtcagccggctgatcagataaactgataagccagatgaagtcaacgggaggttttgtttatatcgcctggctgaggtgcttggaaaaaccatttttaaagcgttttttcttactattgtttaagagtccagggagcaaagaagcagcccacgtcttgatgtggccaccaagaataaataattctgaatttgc

SEQ ID NO: 48 - DNA, 892 bp, Mus musculus
aaaagctgtaaccataatttaaaaccaagttcattatgtctatgaagctcacactggagactgagtcttaggtgaaagcaatatcgtgtacgttccagaatgaaagcattgcactgtacacttcatctcagccgctatgtctcagatttcttaaaaatgtaactgtgtggctagctgactagcccagaacagaatcatactttccagcttacttgtgccagcctggaatctcaatgtcacttaccaaaagaaaacacacacacacacacacacacacacacacacacatatatatacacacacacacatatatatatacacacacacacacacagtgtcgctggaaggaagtgtgttatatcaggactcttacttcataatctacacataccatcagtgcccaagtgtgcgagctgaagatgcagagtggaagaaaaattcgtgtgaagatgtaatattagtgtcttaagagaacagtgtaatattagtgtcgtgccagtgaaatgtgtcatcatccaatagagagagacgctctagtggccttctatgaatagttactctagtggggtggcacttttcaaagagcagtggtatgccgggatcaaaaaacccccccccgcagataacaccaccagggtatatggtcacaactactcttcccccacacttgggtgtgggccatagttatatataagaagcacctaagtagatcggtggaattcaaaaccaacccagattattagggaagaagtaaacagtggattcctgcggcaagaaaaaacaccaaagatccatcccgagcgaagaaaataaacacataagttggaaagcggggagccggggaaaaaccaggggcattgggaaagcggcggtagaaaggacaccccaagga

SEQ ID NO: 49 - DNA, 782 bp, Mus musculus
  modified_base (538)..(538): a, c, g, t, unknown or other
  modified_base (615)..(615): a, c, g, t, unknown or other
  modified_base (662)..(662): a, c, g, t, unknown or other
  modified_base (713)..(713): a, c, g, t, unknown or other
cctgtgtgactttctagagaaccaggacacccctgagcctttcctgggaactcctaaggaagtcacaggttcacaccgtggggattttcaggatagcatggagaccagagaatcccggttcggttgttctcactcggtgagccttgagaaggaagagactgaccagaaacactcactcagcactctggcaggagcaggagaagatactttaagatgaatctttgggatagattttgatacacccaataccatacacacaggagcttggcatttgcaaagtctattcagtttccttccacactctgacccacggttgtagcggagtgggctgaacactgtaacactgtacatgcgatttccccatgggcttctaaaatgtcaccatctcctcccctgctgtgtcctactccatttactggttacaaggtgatgtcaacaagagaagctatcacaacaccagggctgtgcacacgtgcacacacatgtatgcacaagcacacagatgtatgtacagcacacacacacacacacaccccanaaggagagaaaaggaagaaaacatttataaaaagcgacagctacccccatattcaaaaatagttcttttcgctgtanggaaacaggtagctctccataaggaaattatcatgagtgtgttctcncatcagtgcacttctcccaggggtgctcactgaagctggtccacgtctatnaacaggtgacactggctgcagcaaaagcattcgttcacacaattgatctctatcatcttggatctgatt

SEQ ID NO: 50 - DNA, 440 bp, Mus musculus
tttttttttttttttttaggtacgctacacgataaacaagtgtttggggatttatttcacattagagataaaacgggcaaatgtatatatagtacctggagattgagcactgagctagtaccctgacttcctcttgagacacacactatattcagctaaggttccaccctgtgcccccacaaggtcaggcctccatgtactgttccagtaacaaatcctcacaattatagtaaggagcaggcagactggtcacagcctgccttccactactgagcactttgtcattgcatgaaatgctttaaatacgttcatcgatcaaaccgtacagctttgtttcaaagacagtgagaatgatgggctctgctgggcacccctgatttcaacttagcatagataatgccagtcagccagccagcaacagaaactcacgtgtgaaaata

SEQ ID NO: 51 - DNA, 2159 bp, Mus musculus
cagagccttcccccgcagccctgcttagagctgtcccgtgcaccctgagccgggtgtgcaaaccagccagacccctcctccagcagtcctggtcctgtggacttgcgagcaatccagtccttagatgctttggttccatcttaaaagctgttcagcttgacttcagaagaacagtttggaggacgtaccatgcgggcactgtgcctgctttgttgggctgttctcctgaacctggtgcgagcttgtccagagccctgtgactgtggggagaagtatggcttccagattgcagactgtgcctatcgtgacctagagggtgtgccaccgggcttcccggccaatgtgaccacactgagcctgtcagccaacaggctgccaggcctgccggagggagccttcagggaagtgcccctattgcagtcgctgtggctggcacacaatgagatccgctcggtggctattggtgctctggcccctctgagccatctcaagagtctggacctcagccacaacctcctctctgagtttgcctggagcgacctgcacaacctcagcgctctgcagctgctcaagatggacagcaacgagttagccttcatccctcgggacgcctttagcagcctcagcgccctgcgttccctgcagctcaaccacaaccgcctgcacgcgttggccgagggcaccttcgcaccgctcaccgcgctgtcccacttgcagatcaatgacaaccctttcgactgcacctgtggcatcgtgtggttcaagacatgggccctggcctcagcggtgtctattccagaacaggacaacattgcctgtactacaccccacgtcctgaagggtatcccactaggccgcctgccacccctgccctgctcagctccctcagtgcaactaagctaccagcccagccaagatggagcagagctacggcctggcttcgtgctggcactccactgtgacgtggatggacagccagtcccccagctccattggcacattcacaccccgggcggcacggtggagatcgccagtcctaatgtaggcactgatggacgtgccctgcctggtgcccttgcaaccagtgggcagccacgcttccaggcctttgccaatggcagcctgcttatccctgactttggcaagctggaggagggcacctatagctgcctggccaccaatgagctaggcagtgccgaaagctctgtaaatgtggcattggccaccccaggtgaggggggagaggatgctgtggggcacaagttccatggcaaagcagtggagggcaagggctgctatacggttgacaacgaggtacagccatccggaccggaagacaacgtggttatcatttacctcagccgtgctgggcccccagaagctgcaatagcagcagacgggaggcctgcgcagcagttctctggcatacttctgctaggccaaagcctgcttgttctctcctttttctacttctaactacaccctgccctggttggctagagcagctccagggccttcctaactccccctgatcacgttcctgccaatgttccgtcttaacaccacgaggtctggaattggtgaggcctgaggttagcctggggacttcacattttcctatcaccttttctaagctcatccaggccgctcattactccaatttgcagatctgctcagaactagcagctaggatagaactatatcccaaaactcatcatctctagtgctagttgctgctaacagcattgcctgtgctcctagcaggggcagcctgctaacagggcaacaacaatgtcttaacctgacctactttgagagttctagccatggaggtaaagagcttgtggaggccatccaggtgggcactggggctgggctagaagggggtctggagtggccagtacaggatctggaaaggaggtaccacgggccatggctgggcaggctaaaagctttcctgtttttagatgctctctgatgagatatggaaatcatccctcactgggcctttctctcctctcaccccaagccccacagcatgtgcctgcctcttgagacacttactccccctcctcctctgaagaggctagccagtctgggtagcagaaaaataaataaataaataaataaataaataaataaataaaaaaaaaaaaaaa

SEQ ID NO: 52 - DNA, 6607 bp, Mus musculus
atggccttaggcacacagctgatgcttctgctgtggaaaaattacacctatcgacggagacaaccgatccaactactagtggagttgctttggcccctcttcctcttcttcatcctagtggctgtccgtcactcccacccccctctggagcatcacgaatgccactttccaaacaagccattaccatcggcgggcacggtgccctggctgcagggccttgtctgcaacgtaaacaactcctgcttccagcacccaacgcctggcgagaagcctggggtcctgagtaactttaaggattccttgatctcgaggctcctcgctgatacccgcacagtgctcgggggccacagcatccaggacatgctggatgccctggggaaactgatccccgtgctcagggcagttggaggtggagcacgaccacaggagagtgaccagccgaccagtcaagggtcagtgactaagcttctggagaagatcctgcaaagggcatccctggatcctgtgctgggtcaagcccaggattctatgagaaagttctcagatgctatcagggatcttgcccaggagctcctgacactgcccagcctgatggagctccgagctttgctgcggaggccccgagggtcagctggttctctggagctggtttcggaggccctctgcagtaccaagggacccagcagtccagggggcctgtccctcaattggtacgaagccaaccagcttaatgagttcatggggccagaggtggcccctgccctgcctgacaacagtctcagccctgcctgctctgagtttgtggggacactggatgaccaccctgtgtctcggctgctctggaggcgcctgaagccattgatcctcgggaaaattctctttgcacctgacacaaacttcactcggaagctcatggctcaggtgaaccagaccttcgaggagctggctctgttgagggacctacacgaactctggggggtgctgggaccccagatcttcaacttcatgaatgacagtaccaacgtggccatgcttcagaggcttctggatgtggggggcacagggcagaggcagcagacacccagagcccagaagaagttggaggctatcaaagactttctggatcctagtaggggtggctacagctggcgggaggcccacgcagatatgggacgcctggctggaatcctaggacaaatgatggagtgtgtgtccctggacaagctggaggctgtgccctcagaggaagctcttgtgtcccgtgccctggagctgctgggtgagcgccgcctctgggcaggcatcgtgttcctgagcccagagcatcctctggacccatccgaactgtcatctccagccctgagtcctggccacctacgattcaagattcgaatggatatcgatgatgtcacaaggaccaataagatcagggacaagttttgggacccaggtccgtcagcagatcctttcatggaccttcggtatgtgtggggaggcttcgtgtacctgcaggacctgctggagcaggcagctgtgcgagtgctcggtggcgggaactcccgcacaggtctctacctgcagcagatgccacacccctgctacgtggatgatgtgttcctgcgggtgctgagccggtctctgcctctgtttctgactctggcctggatttattcggtggcgctcactgtgaaggccgtggtgcgtgagaaagagacacggctgcgagaaaccatgcgtgcgatggggctgagccgcgcggtgctctggcttggttggttcctcagctgcctgggacccttcctggtcagcgctgcgttgctggtattagtgcttaagctagggaacatccttccttacagccacccggttgtaatcttccttttcttggcggccttcgcggtggccaccgtcgctcagagttttctgctcagcgccttcttctccagggccaacctggcagcagcctgcggggggctcgcctattttgcgctctatctgccctacgtactgtgtgtggcctggcgcgagcgcctgcacctgggcggactcttagctgcgagcctgctgtcccctgtagcctttggctttggatgcgaaagcctggcgctactagaggagcagggagacggggctcagtggcacaatttgggcacaggccccgcggaggacgtcttcagcctggcccaggtgtctgccttcctgttgcttgatgccgtcatctacggccttgccctctggtacctagaggctgtgtgcccaggccagtatggaatccctgaaccatggaatttcccttttcggaggagctactggtgtggacctgggcctcccaagagttctgtcttggcccctgccccacaagatcccaaggttctggtggaagagccaccccttggcctggttcctggtgtctccattcgaggcctgaagaaacattttcgtggctgtccgcagccagccctgcaaggactcaaccttgacttctacgaaggccacatcactgcctttttgggtcacaacggggctggcaagacaaccacactgtccattttgagtggtctcttcccacccagtagtggctcggcctccatcctgggccatgatgtacaaaccaacatggcagccatccggccccacctgggcatctgcccgcagtacaatgtgctgtttgatatgctgacagtggaagaacatgtttggttctatggccgtttgaaaggcgtgagtgcagccgccatgggccccgagcgggaacgtctgatacgggatgtggggcttaccctcaagcgggacacacagacacgccacctctctggtggaatgcagagaaaactttctgtggccattgcctttgtgggtggctctcgtgtggtcatcatggacgagcccactgctggtgtggaccccgcttcccgccgtggcatttgggaattgctacttaagtacagagaaggtcggacactgattctctccactcaccacctggatgaggcagagctcttgggagatcgcgtggccatggtggcaggtggctctttgtgctgctgtgggtccccgcttttcttgcgccgacacttgggctgcggttactacctgaccctggtgaagagttctcagtccctcgtcacccatgatgctaagggagacagtgaggaccccagacgggaaaagaagtcagatggcaatggcaggacgtcagacacagcgttcacacgaggaacctcagacaagagcaaccaggccccggctcctggcgccgttcccatcaccccaagcacagcccggatactagagctagtgcagcagcatgtgcctggagcacaactcgtggaggacctgccccatgagcttctgcttgtgctaccctatgcgggggccctggatggcagcttcgccatggtcttccaggagctggatcagcagctggagctcctgggtctcacaggctacgggatctcggacaccaacctggaggagatcttcctaaaggtggtggaggatgcgcacagagaaggtggggactctagaccgcagctgcaccttcgcacatgcactccacagccccccacagggccagaggcatcagttctggagaatggggagctggccccacagggcttggcacccaacgctgcccaagtgcaaggctggacacttacctgtcaacagctccgggctctgctccacaagcgttttctgcttgctcgccgcagccgccggggcctgtttgcacaggttgtgttgcctgccctctttgtgggcctggccctgttcttcagcctcattgtgcctccttttggccagtacccacccctgcagctcagccctgctatgtatggccctcaggtctcgttcttcagtgaggatgcccctggggaccccaaccggatgaagctgctggaggctctgctaggggaggctgggctgcaggaacccagtatgcaggacaaagatgccaggggatctgagtgtacacactccctagcttgctacttcacggtccctgaggtccctcctgatgtggccagcatcctggccagtggcaactggacgccagaatctccatccccagcttgccaatgcagtcagcctggagcccgccgcctgttgccagattgcccggctggagctgggggtccaccacccccccaggctgtggctggcttgggggaggtggtccagaacctcactggccgaaatgtgtctgactttttggtgaagacataccccagcctggtgcgccgaggcctaaagaccaagaagtgggtggatgaggtcagatatgggggcttctccctgggaggccgagatccagacctgcccacagggcatgaggtggtccgcacattggcagagattcgggcactgctgagcccccaacctgggaatgcgctagaccgtatcctgaacaacctcactcagtgggcccttggccttgatgctcggaacagcctcaagatctggttcaacaacaagggctggcatgccatggtggcctttgtgaaccgagccaacaatggactcctacatgccctcctaccatctggtccagtccgccatgcccacagcatcactacactcaaccatcctttgaacttgaccaaggagcagctatctgaagctacactgatagcctcctctgtggatgtccttgtctccatctgtgtggtcttcgccatgtcatttgtcccagccagctttaccctggtcctcatagaggaacgcatcaccagagccaagcatctgcagctggtcagcggcctgccccaaaccctctattggcttggcaacttcctctgggacatgtgtaactacttggtggcagtgtgcatagtggtgttcatcttcctagcctttcagcagagagcctatgtggccccagagaacctgcctgctctcttactcttgcttctgctgtatgggtggtctatcacaccactcatgtacccagcctccttcttcttctcagtgcccagcacggcctatgtggtgctcacctgcatcaacctcttcattggcatcaatagcagcatggccaccttcgtgctagaactgctttcagatcagaacctgcaagaagtgagccggatcctgaaacaagtgtttcttattttcccccacttttgccttggccgagggctcattgacatggttcggaaccaggccatggcagatgcctttgagcgcttaggagacaagcaatttcagtcacccctacgctgggacatcattggcaagaacctcctggccatgatggcccagggacctctgttcctcctcatcacactcctgctccaacaccgcaaccgtctcctgccacaatcaaaaccaagactgctgccgcccctgggggaggaggatgaggatgtggctcaagagcgtgagcgggtgaccaagggggctacccagggggatgtgctagtcctcagggacttgaccaaggtttaccgtgggcagaggaacccagctgtggatcgcctgtgcttagggatcccccctggggagtgtttcgggctgctgggtgtcaacggggcagggaagacatccaccttccgcatggtgacaggggacacactgcccagcagtggtgaagcagtactggcaggccacaacgtggcccaggagcggtctgccgcacaccgcagcatgggctactgtccccagtctgatgccatcttcgacctgctgaccggccgggaacatctggaactgtttgctcgcctgcgcggggtgcccgaggcccaagttgcccagactgcgctctctggcctggtgcgcctgggccttcctagctatgcagaccgacccgcgggtacctacagcggaggcaacaaacggaagctggcgacagccttagctctggttggtgacccagctgtggtctttctggacgagcccaccacaggcatggacccaagtgcgcggcgatttctttggaacagcttgctgtccgtggtgcgcgagggccgctccgtagtgctcacgtcgcacagcatggaggagtgcgaagcgctctgcacgcgcctggccatcatggtgaacgggcggttccgctgtctgggaagctctcagcatctcaaaggcaggttcggggctggccacacactgactctaagggtcccaccggaccagcctgagccggcgatagccttcatcaggatcacattccctggggctgaactccgggaggtgcacggcagccgtctgcgcttccaactgccaccggggggcagatgcaccctgacacgagtgttcagggagctggctgcccagggcagggcccacggtgtggaggacttctctgtgagccagaccactctggaggaggtgttcctatatttctccaaagaccaaggggaagaggaagagagcagtcggcaggaggctgaagaagaggaggtttccaaacctggccggcagcatcccaaacgtgtcagccgattcctggaagaccccagctctgtggagaccatgatctgagcatgcctgccttgggactgagtggcaaagctcagacagaggatctctgtaccatacgctggctcccagaaagccttgggctctgggggaaataaaaagaaactagaatgagaaaaaaaaaaaaaaa

SEQ ID NO: 53 - DNA, 2707 bp, Mus musculus
gcgaggatcctggaataaagggcaactagcagccccaggaaagtctcccagaaaatgttaatccgatttagagaccccagagtctggccctccaaaccaaatgtttccaggtccctaaaacttcagatcccatcgcctcagccattccccaaatggaccaccagatggcaccagcaagcaacgaggatttcaaaaccaaaactaaactgggaactcagattttttttgctgtttatgcaaatgcttcattccctgaaacattcctccgggaatggtcaccccctccactgccacaatccttccctcccctgtatgcctactccctccttcaacttacagtgcctgaagactctgtcaggagagctgaggacccaaaacaaactggccttgagacatgtggctctttgccctcctggtgaccctgttctatggggtggaaggctccatttacctccctcagaagctctatggagaggtgacctcccctctgtatcccaagccttaccccagtgacttggagacaaccactgtgatcactgtccccatggggtacagggtgaagctggtcttctggcagtttgacgtggagccttctgaaggctgcttctatgactatgttaagatttctgctgataagcaaacactggggaggttctgtgggcagctggattctcccctgggcaaccccccaggaagcaaggaattcatgtcccaaggaaacaagatgctgctgaccttccacacagacttctccaatgaggagaatgggaccatcatgttctacaagggcttcctggcctactaccaggctgtagaccttgatgaatgtgcatcgcagcccaactcagtggaagagggtttgcagccccgatgccaacatctgtgtcacaactatgttggaggctacttctgttcctgccatcctggctatgagcttcagaaagatgggcaatcctgccaggctgagtgcagcagtgagctctacacagagccctcaggctatgtctccagccttgaataccctcagccctatccaccggatctacgctgcaactacagcatccgggtggagaggggcctcactgtgcacctcaagttcctggatccctttgaaattgatgaccaccagcaagtgcactgcccctatgaccagctccagatctacgctaatgggaagaacttgggtgaattctgtggaaagcaaaggcctccagaccttgacaccagcagcaatgcagtggatctgctgttcttcacagatgagtcaggggacagccgaggctggaagctgcactacaccactgaaaccatcaagtgcccccagcccaaggctctggatgagttcaccatcatccaggatccgcagcctcagtaccagttccgggattacttcattgtcacctgcaagcaaggctaccagctcatggagggaaatcaggcgctactctccttcacagctgtttgccagcatgatggcacatggcatcgtgccatgcccaggtgcaagatcaagaactgtgggcagccccaaagcctgtctaatggggacttccgctacatcaccacaaaaggcgtgaccacctatgaagccagtatccagtatcactgccatgaaccatattacaagatgctgaccagagctggcagcagcgagtccatgcgagggatatatacctgcacagcccaaggcatttggaagaatgaagaggaaggagagaaaatgccccggtgtctgccagtgtgtgggaaacctgtcaaccctgtgacacagaaggagcgcatcatcagagggcagccagccaggcccggcaacttcccctggcaggccttcaccactacccacgggcgagggggtggggccctgcttggagaccgctggatcctcacagcagcccacaccatctaccccaagcatcacaacaaggaaaacgacaatgccaaccccaaaatgcttgttttcctgggccacacaaatgtggaacagatcaaaaaactgggacatcacccagtccgtagggtcatcatacacccagactaccgccaagatgaacctaacaattttgaaggagacattgctctactggagctggaaaacagtgtcacactgggccccgaactcctccccatctgtctcccagacaatgagaccttctatggccaaggcctcatgggttatgtcagcggattcgggataacagaagataagttagctttcgatctcaggttcgtcagactgcctgtagctgacagtgaggcatgccagagatggctccagacaaaaaaggatacttctccattttctcaaaatatgttctgttctggggacccagctgtacagcaagacgcctgccaaggggacagtgggggtgtttttgcagtcagggacagaaatcgtgatatctgggtggctacgggcatcgtatcctggggcattgggtgtggtgagggatatggcttctacaccaaggtactgaattatgttgactggatcaagaaagagatgggagacgaaaactgaacccagtgttcactgggtcagaatccagggtatagtgtattaaaaaaaatgtatctgaccaattgttgataagcactatgattctcatataaaaatcaaagatgcagaacgtgtatagaataaactctcttttctgtaatcccaaaaaaaaaaaaaaaaaaaaaaaaaaaaaaaaaaaaaaaaaaaaaa

SEQ ID NO: 54 - DNA, 3263 bp, Mus musculus
agagagagagagagagagagagagagagagagagagagagagagagagccgggtccttctttactctgctgtgctgcctcagaggcgcttgcagcggggagcaggctccaggtgcctgagtctccctaggctcagctcgctctcttggcaccccacccccccaggagcagggcagtacaggacagtatccatcctgaggagtatcttcactccccactctgaggcttcctaactcttcactgagaattctgaagaggggaatgccagcccctagcatggactgtgatgtttccactctggtcgcctgtgtggtggatgtggaggtctttaccaatcaggaggttaaggaaaaattcgagggactgttccggacctatgatgaatgtgtgacgttccagctgtttaagagtttccgacgggttcgaataaatttcagccatcccaaatctgcagcccgtgcccggatagagcttcatgagactcagttcagagggaagaagctaaaactctacttcgcccaggtccagaccccagagacagatggagacaaactgcatttggcacctccacagcctgccaaacagttcctcatctcacccccttcatctcctcctgttggctggaagcctatcagcgatgccacaccagtcctcaactatgaccttctttatgctgtggccaaactaggaccaggagagaaatatgagctgcacgctggaactgagtctacaccgagcgtcgtggtgcatgtgtgtgacagcgacatggaggaggaggaggacccaaagacttccccaaagccaaaaatcatccagacccggcgtcccggcctgccaccctccgtgtccaactgagcacgtccatgataacatgcatctcctcttatcatgcttcccgcccccccccttgttgtttgtccaaacaattaattgcctttaagtccctgggtgtttggttgtttgcgaatccttccttgtaattaagcctctcggacaaaagggctaggcaaaggtgatatgtctcccaatcaactcctacccattaactacaatccatcacttagaaagttctagatagagggtagtattttcttattaaataatcagtacagcccatatctctgttctttcatgttgatccaagccagagacatcggtaatgaagagcctttatgttgtttgtgagctgctccagttcagtcctgtgtgtgtgtgtgtgtgtgtgtgtgtgtgtgtgtgtgtgatgtttttttcctggccacttatataggaccataagtaaacttggctttgactgcatgagatccccctatctggtctcacccagtcctctgcatcccgacattcccaggacatgcacgatcaccagcattgattttgatgattttgagggtatgccccaacttgtggtatcccagccctgtcctgtatagacaaggggcatccgcagcaccattcagctcaataagtctgggaatcattattagtttgagtcaattacatcatataactctggccaaattcctggaggtaaaattgagcatggccccaaagatgttgaacatcactaccacagaggtctacccagtgttactggggaggcttgtccaagtgacagagaccgatttcagacaaacctatttattataaaatctcatagtgtctgaatgactgtcccctacccctttgtatatttgtacagatgtttgagctgtgcttttaaaatctggatgttttttatttagtgattgttcaaccattagctgcttaatgacatcatacctgtgttgcttctgaatgcattctgattctaatgtagataacctgatactattacatgctattgcggttcgtgctaagttgtaaaagggaacagcaatgtctcatgccaatagataactgactagccaacctttgctgtccaaaccacctgtttccaaacaaagatccaagtatcagttataagcaacttgggtgacgctaaatccaagaaatgtatacagctgagcatttcagagcacaaaggatgatgggtaaacggatgcccttcccattcatccaatgcccatgcgctcaaaagttccttgtttttgttatgtgtgacttttgtatatctctagcccaaagtgcattacagaagatacacctgcagaaccatactttctgctccatgtgtcaagcctcatctattcctgttcattaactagtaactttggatgcaaataccatttaccacacaacaggcaaggactttcatggcctaagcctcggagtaacacacaagaacactaacacagccacctgatggggggataattgtggttttttgattaaggtgtatgttagtttccgcagaaacttcaaacctagactgatcattcagaaaattaaaagtccgttctactgtgaaatatagcaatatagtgccggacacggtacagtacgattgagaccgaggacagtattgcttgtggaatcctaagtttccatggggaaaacaagtcgtcttttcaaaatcagatctgaggagtgtacacagtaagcaaaggctttgactttcctttgttgtggaaggttttgttttcttttttttaaattggccatggaaagactagaaatagtggcgagatgatgccctctcgtggcagaaacagtgaaatcggttgtatagatggattgattacaacagtcaactaccaggggctgaccttctaatccacattaactttcaggatgcaggagagagagagagagagagagagagagagagagagagagagagagagagaaacaaaatgaaagtctgggaaataatttgcgcttccaaacaatgatagcagaaatgtctaatttagtaaaagttgagtgtgactaccttgcatagtccttaagaactcagtgttctagacggcccagatgattagtcttagtaaactgtattgccatctgttgacgttaacctgctacagatcaaggggttctcgcgctagattgagcatggggacgggggagggggagctttccccagaaggaatggggaagccacgggacctcccagcatcgagaaagtcacctggacacttccatgatgctcattatgcaaacctctttagcgctcttttaagtttgaaacgtttttaaatggaggggaaggggaaggtttccaccaactgaatcatttgtgcacgtgtacagctcaaagagcttagagttcaaatatatctggtgaatgactgtcaaaaaaaaaaaaaaaaaaaaaaaaaa

SEQ ID NO: 55 - DNA, 1731 bp, Mus musculus
ttggggcgagcagcttcgacctcgctatggcgcccctactgcagcttctgtggctgctgacactgctctcgactgtggccctgagccccgtccccgccaagccctgggcagatgacgagcaggcctggaacttgtcgtcccaggagctgctggcccccgcccgcttcgcgctggacatgtacaattacggccgtgctgcggggacaagggccgtgctaggagcggtgcgcggaccgtccgccgggccggccagggctctctgttctccctggaagccacactagaggagccaccttgcaatgatcccctggtgtgcccactgcctgagacgaagaaaacagtgctctgcagttttgaagtcctggaagagctaaaagaacacttgctgctgaggagggactgtagcccagtgaatgccaaggtcacagagtttagaaatgcgactttcagctcattccttccattgttggacaaggatcccctgccccaggacttctctgtgaagatggctccactcttcaaggacttcatgaccacctataaccggacttatgaatcaagggaagaagcccagtggcgattgactgtctttgcaagaaatatgatacgagcacagaagattcaggccctggaccgcggcacagctcagtatgggatcaccaagttcagtgacctcacagaggaggaattccacaccatctacctgaatcccctcttacagaaggagtctggcaggaagatgagtccagccaagtccataaatgatcttgccccgcctgaaatgggactggaggaagaaaggggctgtcactgaagtgaagaacagggcatgtgtggctcctgctggccttttctgtcacaggcaacgtggagggcagtgttccatgaaccgggggactctgctctcctagtcagagcaggagctcttggattgtgacaaggtggacaaggcctgcttgggtgattgccctccaacgcctatgcagccataaagaatttgggagggctggagacagaggatgactacggctaccagggccatgttcagacctgcaacttctcagcacagatggcaaaagtctacatcaatgattcagtggagctgagccggaatgaaaataagatagcagcctggctggcccagaaaggacctatctcagttgccattacaccttcggcatgcagttctatcgccacgggattgctcacccattccggcccctctgcagcccttggttcatcgaccatgctgtgttgctggtgggctatggcaaccgctctaacattccttactgggccatcaagaacagctggggcagtgactggggtgaggagggttactactacttgtaccgtggatctggagcctgtggtgtgaataccatggccagctcagccgtggtgaactgagagttgctggctcaggacctatgttgtcacagtggccccttccttagcccgactcatgcccaggcccttcctcacgagacagagctggttggctgagggccgggcactttggacctcacggtgagccctgggccctgggccccttcgtccctctttcctctagtgctcatctgaagttccccagctgcacctgtgtccgattgtggtagctaggaggatcctgaggtgcaggaggctttcatggaagccagcgccggggcaagaacctggctacagtatgatgcaggatgaaaatatgctcgtcataaaactagatctgcc

SEQ ID NO: 56 - DNA, 688 bp, Mus musculus
caaattaaaaagaattggatatgagtatttgagtctgtgcccatgatgctggagggtgtgagtcagatccccgggagctggaattatgttgtgacccatttgctgtgggtgctgggagttcaagcccaccctctgtgcgagtagcaagtgttcccaaccacttccatcccccatgtttggcttttatttcatatattcaatttaatttaaatcccagagctgtaagaaacatccgtttattgtctagtactgtctctgacaatcaaaataatattgactatttcctccaattgcttgaaaagattaatcctgatttacaaaaaaatattttttgacccagggtctcttcacaagcccaagttggactcgaacctgcaattttcctgcctttgcctctcacatgctgggagacaaatgaaagaacttagggaagcgcagaaaaccatcaccactacaggatcgtcccagaaggcagaatctcgcccacagagaaactgtaactgaaaagtacagaagttactattcttgaaaagccagtaactcttttgattctgtttaaggatggttttcctgagccagtgaaatggctcagtgcgcaaaggggcttgctgccaaatctgataacctaagttcagttcccggaacccacatggactatctgtgccacggcatgtatgagaccgcgcgc

SEQ ID NO: 57 - DNA, 3307 bp, Mus musculus
ctcgcggcccgctccgcgcctgatcgcccggtgcagcgcagctcagcgcggcgcagcgcgactacctttctgcagccgagcggtcggggctggtcaggacaaagaggtgtgagcaggcttactgagctggctgatccatcatggcggagaaagtgaacaacttcccaccattgcccaaattcatcccactgaagccatgtttctaccaagacttcgaggcagacatccctcctcagcatctcagcttgaccaagcgcctctactacctctggatgttgaacagcgtcacgctggccgtgaacctggtgggctgtctcgcgtggctgatcggaggcgggggagccaccaactttggcctggcctttctctggctcatcctcttcacaccttgctcctacgtctgctggtttcggcccatttacaaggccttcaagacagacagttccttcagcttcatggcattcttcttcaccttcatggctcagctggtcatcagcatcatccaggctgtgggaattccaggctggggtgtctgcggctggattgccaccatttccttcttcgggacgaacatcggctcagcagtggtgatgctcattcccacggtcatgttcacagttgtggccgtcttttccttcattgctcttagcatggttcataagttctaccggggtagcggaggcagtttcagcaaggctcaggaggaatggaccactggagcgtggaagaacccacatgtgcagcaggcagcccagaatgcagccatgggggctgctcagggtgccatgaatcaaccgcagactcagtattctgccactcccaactacacgtactccaatgagatgtgagccagccaagcccaccaggaggcagggctgggggccagtgggacagggggcttaagccacatcttctgtgtggtgaccaagcagggttcccccttcccttttctcctccccaactttgtacaaagaatcagagttatatatatatatatatatatgtgtgtacgtatatgtatatgtctatccctgcccccacctttgggtcctctgggaactttgcactgcacaagaagtgttttctgtgcattggtagccaagcctatgtccccttgtgagataatgtacagtggcgatctcttgttgtggtgctagatgtatgtttagaactaaaccagccccctccatccatcaggttgtcccctctgaccctggcccagagactccacaggccagggggaggcctagcagggagccagataccttgtgcagggtgatgagcctaagctatttctgcctttagtcccattgggaagcaacagtattagtgttcatggtgataggcaggttctaggcgatgggacagagaggatgtccccttgctccctgtagtcctccctccacctcctcttcccctcgttcctccctcattgtgagattctttgtgctcatttccctagctggctcctccgtgatctttttcctccccatgtagcttttcgttgtcttcctaaagcggggtgtctcagttatgtctgcttttaagactacccagatacccccaatccgctccccagttccaggaagctgacatgggagctcagccaaccctgacgtggaaggggcacccagcttggggattctgagcccatttggtacttgatacgggggaggggggggaatggaaatgcagagctgatctccttgattctgcaagcctggcccgcagaggcaggcatctccttttccctctcctggcttccaccccttgctgcccagatccaccttgagccgctctgcatttcccgctggcttgtatgaggcacttgccaggtgtaaaggccgtggtggaacagagggcatcattggtcgctgggggaggtgtggctggccccagctcagaagggcttctagcttctcaaagtgaccactggattcctggaaggagtagctgttctaattgagtctggcagaaaggatagaggtcagaaggttaggtctgaagggggaagatctgaggagaagtcaaataggacccattgagagggtagttcacctctccagtctcccttgtcctggctacaggacacattctgcagagatgctcccaggcccagttcaagctgcaagcacaatgtcctgagtaggattcctggttggcaggaggaagggcaggatggctctgcctttagtttttagtttagtgttctgtccttccctcctcttccattcacgagaacgacaggattcgattccaggcctttccttagttctcttagaaccctcatctctctctagactgatcttagttcctgggactgtatctttcaagcagggtgtggacattgtctggtatcttattcctctgcatgaggcctgaggtgggtaggccttaccaaggagcagctggctgtttctcatctccttgcaacagaaacccacctaggctagggagactggaaaaccataccacattggtttgccttggaccctaagacttggtttcaggccaccttgagctttgatttttcagcttcttccttgtaagagaatccaagagtgtctggaaagttcctttcctgttgactccctaggcttagttgattctctcccctactgttttctctatggagagcagttgtcatagctcctgctaccctgagagattctagggctaggctcttcctcctcttcccttctcccagctccctttctcttagtcctctgttacttccaggaaagctgtgatccagctgccagcctagcatccacagctgttgggtgttacccccagtcaacttcctgtcctatcggcctctcctctttcctggctcacacctattggccatgcctggcactgcccttgggaaagcctgtcaccagtgtctggcccagctgctcaggcactgggatgctgcatcttcaggcaactatgcactttgatgaggagagagtgagagagatggggccgggcacagatggtttgcttgaggggtgggagggcctggtggatgctgggagtcctcctgtctgtcgccagccagtgacctgcttttgcattctcctggtgcccactgccccttgtttctgagagacacaaactatcccctcattggcagttgacctgcccgagccagtgtctatctgtgtaactggatgaatataataaagggatcatttgaccctgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 58 - DNA, 642 bp, Mus musculus
  modified_base (34)..(34): a, c, g, t, unknown or other
tttaaggaaaaaaaaaaaaatctaaccaagaaanttgcattaatttacttggttttgtagaagaacttttttttattttttacattttttggtgtccgtttgtattgaataatttgctacatttgtaaaatgtaagaggtatatatataatatatgtatatttctaatgtaagaaacgtaatttttttcttttcaagatttttttttaaaaagaggagagaaaccaatattttttcaggaaaaacaaactttaaaaaataggaacataaaaccacctccacccctcgccccatcctctctatccctctcacccaggagcaaaacagaaggtggataagattgtcaagaatgtcagctgtcagtcacgctgtctctgtcttgatgctgtagtctctagagctccccctagagatgggagcaggcactgaagcagccatagagaggagcccgggagcggggcgacctttttttctctagcgaaggaagaatgcaatcaagacgttttgtattcagaacattgtgcaatattttggaatgagacattggtgtgtttagagatttagtttcaaaacaaagattgatcaaatctgtacagtttatattgttccagatttttttaagtttgtattaaaagcatgatat

SEQ ID NO: 59 - DNA, 660 bp, Mus musculus
tgtacagtagtcagacccactggctactctctacaagacctgggtttattttcagcacccatgtgacagcttacaactcaagccccagggactacccctcctggcctctagggtaccagcatgcacatggtgcacagacatacatacatacaggcaaaagactaatacacaaaaataaaataaaccaattttttaaatatcataaagagtaagaaggggctatgagtgtaatttggctggtagagtacttgcctagcatgcatatagcccaggcttgatcacctggcaccgcataaagtgggtggacacctggaacacacatgcagtctcagcactgtggaggtagacataggcagatcagaaattcaaaggcatcctcagcgacatagggagttgaccagtaaggatttcactggacccagtctcaaaattgagtaagagttgaaaagatacttgtatagcataaaacctatgagagattcatgagtcagtaatacaatgagataagttatgctttctaaggaaggatgcatagagacatttcaaaggagaagaaacaaatctccattaaatgtttgcaagtatgttcaaactcactgggttttagggcaatattaaatcaaattatagagtgttagtttgcccacattagcttagttt

SEQ ID NO: 60 - DNA, 2972 bp, Mus musculus
cgtaaagccttagttcttgaacgaatgaaagggtgacatagtgtgtggcgtgtacggggtgcagcttggctgacacgctacagagaatcctggggaggtactggcttagacaccgccatcccagacgccaaggtaaggcttcatctaacactaatttacagccgcagtccgaggacagacaaagaacgcaggccaaccaggcacgacgccactgcgcagtcgcaggagctagttgggacttgcgtagctctgccgctgggagggtccgcgcaggcgtagagagagttggcgacaccgatcgcgctctagtctgcgcttccggcgccgggcctgtggcgttccgcagtcctgcgtgtatttacctcctactcctcatccgctgctaggcaaccggccggccaagctgcttgccttgcgcctgcgtcgggcatctgtcttccgcccctagctggcgccatcatgctgctgcctgtgttcactctgaaactgcgccacaaaatcagcccccgcatggtggccatagggcgctacgacgggactcacccgtgcttggctgccgccacccaagcgggcaaggttttcattcataaccctcacacgcggagccagcatttcagtgcttccagagtgttccagagccctctggagtctgatgtctctctgctcaacattaaccagacggtcagctgcctgggttcgggagtcttgaaccctgagcttggctatgatactcttttagtggggacacagaccagtcttttggcttacgacatctacaataattcagatttgttctacagagaggtctcagatggggcaaatgccattgtgctggggaccctgggagacattgccccacctcttgcaatcatcggtggaaactgtgctctgcagggtttcgatcacgaaggaaatgatctcttttggacggttactggagacaatgtgcattccttggctctgtgtgactttgacggtgatgggaagacagagcttcttgttggatctgaagattttgacattcgagtttttaaagaagatgagattgtggcagaaatgacagagacagagatagtcacctctctgtgtcctatgtatggcagtcggtttggttacgccctttctaatggcacagttggagtttatgacaaaacagcccggtactggagaattaaatccaaaaaccatgccatgagcatccatgcttttgacattaattctgatggagtgtgtgaactgataaccgggtggtctaatgggaaggttgatgctcgcagtgaccggactggagaggtcatatttaaagacaacttctcttctgctgttgctggtgtggtagagggagattaccggatggatggccacgtacagttaatctgctgctcagtggatggggaaatccgaggctacctgccaggcacagctgagatgaaggggaacctcctggacacaagtgtggagcaggacctgatccgagagctgagtcagaaaaagcagaacctgttgctagaacttcgcaactatgaggagagcaccaaggcagaactgagcagtcccctgaacgaggccgatgggcagaaaggcataatcccagccaataccaggctccacacagcgctctcagtcaatatggggaatgacttacaagatgcgcatgcggaattaggcatttccacttccaatgatactatcatccgagcagtactaatttttgcagagggaatttttgtgggtgaaagccatgtggtccaccccagcattcacaacctttccagctccctccgggtaccaattacacctcccaaagatgtccctgtggatctgcacctgaaaaccttcgtgggttacagaagcagcacccagttccatgtgtttgaactgacaagacagctgccccgattcaccatgtatgcattgacaagcccagatgcagctagcgagcctgtcagctacgtgaacttcagtgttgccgagcgcacacagaggatggtcacgtggctcaaccagaactttctgttgccagaagacagtaacgttcagaattccccgtttcacgtctgtttcacatcgttacgcaatggtggccagctctacataaaaatgaaacaaagtggtgagatcactgtgaatactgacgatattgatctagctggtgacatcatccagtcgatcgcgtccttttttgctattgaagaccttcaggtagaagcagatttccctgtgtacttcgaggaactacggaaagtgctggtgaaggtggatgagtatcattcagtgcatcaaaagctcagcgccgacatggctgataattctaacctcatccgaagtttgctggtcagagcggaggatgctcggctgatgagggacatgaaaacaatgaagagtcgttacatggagctctatgaccttaataaagatttgctgaatggatacaagattcgctgtaacaaccacacagaactgctaggaaacctgaaggcggtgaaccaagcaatccaaagagcaggccgtctgcgcgttggaaagccaaagaaccaggtgatcagtgcttgtcgggatgcgattcgaagcaacaacatcaacaccctcttcagaatcatgcgagtgggcactgctccttcataggagacagggaaagaggaaggaagcccctgcaaaaggtctagacacggagcctggctggctcccgatcacagcctgggcatccagctgctaaggatgaaaccatgctaactgatacagctaaggacaaagcactccggctgaaagcctccttcattgatatcagtggtgttgctgatttgtatcttaaaatatatcaccatttcagaatttaacttgtttttgtacataaagttagtgtatgaatttattccccccgaaattgttactgaaatttaaaatggagtacctactttttcattaaaaataaaaggcactggtcttcaaaaaaaaaaaaaaaaaaaaaaaaa

SEQ ID NO: 61 - DNA, 319 bp, Mus musculus
cgacacaactccttaatgttgacctaagcaccagagaggaacgagtacccactgacgtttccgttctctcactgaagaatgaaatgccttctaagctcctgcttcctttcccacctggagttctatgaagcctcatttgctcttcgcctatgaaaacggacagaattcagaggaatattcctgagatcattttttgagagaaatttcttaggagattttttttgtgaagtttaccatgtccatatgaaaaactcattttcaatccctgtcccattcaagtcaacatatccctggtgataggaaaaaaaacaaaaagcaa

SEQ ID NO: 62 - DNA, 387 bp, Mus musculus
caacgtgaacaacagcaaaggcagcatgtcagcagagaagattctttaagagtgacctggagtcgccatgggtccacgtgtgatggcggctgtcccctggccatgaggaaggagaggagacgagattgggggaggcagcggaccacacataaattatttgatgtcatgcctgctcccagttctaaaggacatgagattcctctagatccagaagaacctaccacacaagagactccttcccacttggaagccatgctagacacttggcctgctccccctcctcctggctgctcagaaactcaggaacgaggagtcaatagagcaagacttaaggaaataatgaggtagattgtccattctactagaattaaaattattttctggcct

SEQ ID NO: 63 - DNA, 379 bp, Mus musculus
tttttttttttttttttttttttttttttttgagccttggtatggttgggctttattgcaaaggcaggagtattgtaaaatggctgggggggccctatgcccctccagcaaacaaaaacagaccaaaaaaaggggctttgaaggtgaggtgagacggcaaagtgggtaaaggcaccagcccgccaagcctgacaaacttgagttggatatctcaaacctacatgatagagggcgaaatccaactccccgaaaattctctgccacacccacactgtaggacttccgctcttccggatacccggaagctcttgggacttagccagcaatttttaagggtccagggatcggctatgaatcattgagcaatcactgcagttgg

SEQ ID NO: 64 - DNA, 932 bp, Mus musculus
cggacgcgtgggcggcgggaggcctgtgctgaagacccgcaccttcaccatggcctcggccgagctggattacagcatcgagatcccggatcagccctgctggagccagaagaacagacaaggtgggaaggaagctgggaagcaacagcctgtggtgattctcttgggctggggaggctgcagggacaagaacctggccaagtatagtgctatctaccacaaaaggggctgcattgtgatccgatacacggccccctggcacatggtcttcttctctgagtccttgggcatcccttcacttcgcgtgatagcccagaaactgctggagctcctctttgactatgagattgagcgggagcctctgctcttccacgtcttcagcaatgccggcgtcatgctctaccgctacgtgctggagctcctacagacccaccagcgcttccgccatttgcatgtggtgggcaccatctttgacagtggtcctggcgatagcaacctgataggggccctgagggctctggcaaccatcctggagcgccgacctgcggtgctgcgcctgttgctcctggcagcatttgccctggtggtgatcctgtttcacttcctgcttgctccattcactgccctcttccacacccacttctacgacaggctgcaggactcaggctcctgctggcctgaactctacctctactctagagctgataaggtggtctcggccagggatgtggaacgtatggtagaggcacgcctggctcaccaggtcatggtgcgtggagtggactttgtgtcatctgcgcatgtcagccacctccgagactatcctacttactatacaagtctgtgtgttgacttcatgcataattgtgtccaatgctgaggtcccgctccggaaataaacgccgacacctcccaaaaaaaaaaaaaaaaaa

SEQ ID NO: 65 - DNA, 810 bp, Mus musculus
  modified_base (738)..(738): a, c, g, t, unknown or other
gcgaacaggacgccttgccgcagcaggcacacactagatctggcctagttctctgctgagcgcgaaatgtctgaagaaaaacctcaacagtccgcggaggagccggaccggggggagcccaagctaagcccgccccagaggagccgggccgggggagccccaaggctaagcctgccccagaggagccggagccgggggagcccaaggctaagcctgccccagagaagaccagcgactactaccgcattagcgagaagctcccagtcaggttcaacaacccggggtggtttcatggctacgggaccaaggaagctgtttccatgtacaggaccagtaaccaaacctacggaagcagagcccccacggtgcatgagatgccaaaagtattttatccatcttcaaataagttttccagacaacacgcagcttttggaatgttccagagtcataatattaatgtcaccctggagaagagcttagtgaccgggcctgacaatcacatcacccactatgaccgtttgaactttcaccccagttacaatgtcaacaggccgtccatctgtgactaggggagctgggttcctgtcctcagggctctcctgactcagggctgcttcggggagcacggatgcccttgatccttgacaggtgccctattctaagggcttggatctcactgccttctcagaaaacacttttcctttccgagaggagaaaaatgtgcaaatagagccacantaccttgtgttctgcattcacacaggaaagatgctgacacatctttgtttttattaaaaatggccacacctc

SEQ ID NO: 66 - DNA, 333 bp, Mus musculus
gattggcactccaaaccagcccccttttcccctcttcatgtactcaaagcactgtaaacattcttatttgaacgtgatattaatctctgattcactatcctgctacagagggtaaatcacctcatttcttggggggtgagggggatatgttctcatgtaacattgatctgtggacaaggttacttctcaactcaagagatgagattcatgtcacttttccttcctgcgagctggaattaaaaccctgtaccacccctggcccctcatttcccactttaatcctcttgagaaagacttaacagttttgtttataataaatgtgtatttctgtgc

SEQ ID NO: 67 - DNA, 1180 bp, Mus musculus
gagtgtctagccactaggttggtggacatgtttgccgactctgcaatctttttgggagagccagtgtggatgggagagagaccagagagaggaggaaggatgttggccttccatctgagagtaatgaagaacgaaggaggtggacttggagaatgtggagggctcccagaaagatatcacccactgtacgtgacctaagtgagaaggagttcaaaatggaaatggagaggctgaccacagagctgcacctcattacccagaagagaaatgggcagagagatcgcctgatctctttccaagagggatccatgaaaaagaggaccaggcccttccagaagatacatccattctatgaacaactatcattaaagaagaaccagctcatgtcctctgtgaacaacttagagttggagataattgagttacaagagaacatccatgagctcaagaaggagataaacttctattcaaacctacatagccagctcatggtggagaagaatcttattaagatgtccatcacacagaaaggggagagcgaggaagtacagattgattgggctctcattgagaaatatttggttgacttgaacctgaatggtaaagacaaacaggagcagaccagcaaccatgagacccaacaacttcaggactcagagactccagcaagagctgaaatgtccacatcccaggaagaaagcctcctgcacaatgagtttctgcctcaggagccccctgctgcactccatccccaacatccacagtctaccttgaatgaatcttcttacattcagtacatttactcggtgtgaataggaggaagccagtgagccagctgattcagggtgttgttccctttcctgttctggcaacaccccttgagtgaggactgaggtgactgcccctccaacagcagtccaagaggagatacaggctgtaggtctgtacttcttaatatgcagtgaaagggtgctgatggacaataattttctgttaatgtttggttaaagttttgctctttattgttttattctttttttaggttttggtgaagttatatgttcttatttagttttcatgtttggatttttcatttatctctttttagtaattgtacttttaaagcttgtttattaaacattgtatttcttataaataaaaattgatttacaactcttgt

SEQ ID NO: 68 - DNA, 463 bp, Mus musculus
  modified_base (413)..(413): a, c, g, t, unknown or other
  modified_base (416)..(416): a, c, g, t, unknown or other
  modified_base (453)..(453): a, c, g, t, unknown or other
aaatacggtggtgggaattatctctcatgatgagtgcatgctatcctaacaaactcagtcagttggtaccagtaaaagcagaaacttgggtatactgttcttcaagaaaagcccgcattgttatcattgtttgcttgtttgttttttaagacactatgtagctctgactgtcctagaacttgctaagaagacagggctggcttaaaatgaaatctgtctacctttgcctctggcatgctggcattaaagctatcactgtatctggtcaagaaaagacacaattttaatttttcatttcaattagtaataatgtcaagcaatttgaaaatttttaagtcatcatggggtcaccctatgggcaattcatatggtcttctattttgtttataaatccttaaaagattttaaaaatnttnccctgaaactacctgaggggtacagacaacagttacnaaacaaaatc

SEQ ID NO: 69 - DNA, 1605 bp, Mus musculus
ccacgcgtccggtgtatttcagtcattccttaatacttactaagagtcctttgaaaactcttgggttaatatccaaaaaaagaacatttcttttccgggatgtgtcttagtaacacagatgtggggggcaggggagaaaaaaaaatgagggtctaatatttcaaagacatgtcaagtttgtgattgggtaggcatcagcttcatggtagtgtccccagatttagcaataaacccatttgcccgtccgaacagtaactattcttttctccgcttttccctttgaagacatgacaatggatgaagtgcgagagttcgaaagagccactcaggaagccaccaacaagaagattggcgttttcccaccggccatttctatctccagcatcgccctactgccttcctcggtgcgcagcgccccctccagcgccccatccacccctctctccacagatgcgccagaatttctgtccattcccaaagaccggccccggaaaaaatctgctccagagacgctcacacttccagatccggagaaaaaagccaccctgaatttacctggcgtctacacttccgaaaagccatgtcggcccaaatcagagtaactcggtctgaacatccctttgggtcctttgttttcatttgtggctttttttttttttttttttaaagaattctctggacgaggaaaagactgcctccttcactcagatgtgttcttggatctcagacaatgcatgtggttaaataatctcacagatagcaagaacccctacgtgtgccacacagcatcatagtgaatgtgaaaagtatgatttagggaaaacaaaaaacaaaaaaaaaaaacaaaaaaacgaaaggaaacaaaacaggaggggctgaggacaccgctcagtgggtagagctgctacagctactgtggaacccggggttccatcccagccatggtaaccaggcaggaggatcagaagttcagggtcaacctcagctacatacagagtttgaggccagcctgagttatttgagacactgtctcaagaacaatcaaacaaaacccacagaatcttctctagctttagatgtggaccagggaggaagccttgttttgggggctttggtgagtctgatgtggacctcaatggtaaaagggtaaatggatgagaaaactttttttttttttttggtaaggtgtggtaaattaatgatgtcagtttcctcccatcaaacctgaaattctcaacaacaacaaaaaaaaaaaaaaagaaaaaaaaatactctcaggtgtcacatgcctaattgttctcttttgggactgctgactaccaatacttgaattccagttgttatcaatattcctattttgatttagtctgactcaggatttggagcctgattaacttcttaaatttttgaaaattttaataaccaacttcttgaggctccaagtgcaattaatgataatgtctttataccttttcacaaaatttaataaagcacccatctgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 70 - DNA, 514 bp, Mus musculus
  modified_base (256)..(256): a, c, g, t, unknown or other
  modified_base (269)..(269): a, c, g, t, unknown or other
  modified_base (286)..(286): a, c, g, t, unknown or other
  modified_base (307)..(307): a, c, g, t, unknown or other
  modified_base (348)..(348): a, c, g, t, unknown or other
  modified_base (354)..(354): a, c, g, t, unknown or other
  modified_base (376)..(376): a, c, g, t, unknown or other
  modified_base (389)..(389): a, c, g, t, unknown or other
  modified_base (406)..(406): a, c, g, t, unknown or other
  modified_base (428)..(428): a, c, g, t, unknown or other
  modified_base (438)..(438): a, c, g, t, unknown or other
  modified_base (457)..(457): a, c, g, t, unknown or other
  modified_base (466)..(466): a, c, g, t, unknown or other
  modified_base (471)..(471): a, c, g, t, unknown or other
  modified_base (498)..(498): a, c, g, t, unknown or other
acaaaaattcaaagattttttttttcataccaatagctagacattggctgggggcaggaacactgtaagatggtacttatactacaaagctttacaaatacaatgtcattaaaacacaggacacacatcaacttgggggttcggtaccttagaaaaacatcagttctgggatggataaacaaaggaacgaatcccgggcaggaataaatgtctgaaagctcaaggggtttatccctgatcctagccacagcgttantgacaccgcgacnccttgaaaaagcgggantttcatattaggggagaattncccccaaaaaatttcccccgtggtttgggttaaccctgttnaaaccnggtccatgtaatggtggggtgnaaaaggcaaggcntttctggaaggcccaanccccaaggtttaaaacccaagnccccggggtngaaaatgggggaaacccgnttttttggngggcnaaataagaaaccttttggttcaaaaanaaacccggttggaagg

SEQ ID NO: 71 - DNA, 384 bp, Mus musculus
gttaaaaataaactttccttcctccctcaccacccacctgtgaggtgaaatgtgctcttgcaaatatgtagaagggacttcctgtccacaggattcctcttctctatctgcacaagagaacactgtccttcctatgtgcaagtcagtatctatgccacctcctccttcacccaagtggactgtgccagtatagtacacatgcctttgcccccaaccccgcaggacctatggtctcctcactctgtctctagcccttcttgcctgtatttaagacgtactcctgctgtgctaagtgctggacagaagcctgacacccctggtgggtgggcctgtggtgttggtctgcctctttccttctttgtcccaataaaacgtgggaggtcg

SEQ ID NO: 72 - DNA, 643 bp, Mus musculus
actctggccgacaatgcagcagccgacttcctcaaggatgtgcagcatctgctcagacaccttcattaacttctagggacggacccacccactggccctgaccactgacccaacagaagttcaaaacatggccagcgagagtcagtatggttctgatggctaacctaccaaggatcccgattagttatgacagacacattaatgcgtaccagctaatcagtggcttctcgctgttcccaagtaacgatcccgatcaaagttctctcgatgactccaggcctatttacaaccaatgaccttttgaatagtcaatgttctctctcattagtgacccagataaataacctgtccattgatcatcctgtgattcgggccagtgactccctcaacccagatcattgatcagttagtggcccacctgtacctgctctgggctctgggtgacaccgaacccaggaatcgattccagcttatccagtgtgccccctgtgtgtcccagactgcggccgctgatcattggcacctggtggagagggatgctgactgcccccacgcaggcccttaacctcattttacctatcctctactaagaacctatcctatcctcatatgaaattacttttaaaaaagccagttatatttc

SEQ ID NO: 73 - DNA, 633 bp, Mus musculus
aggggacactggaattgtgcgcagagcaggcgaccgggcaccggagcccgctctgttctgtcctagggaagctacttcgttccaggcccctatcttcatggggttagtcctcacctggaacctgcgcctccgcagacactgcagcactgcaggagcctgtgacctttgaggatgtggctgtgaacttcagtccaggagagtgggctctgttggattccagtcaaaagaagctctacagagatgtgatgacagaaacctttatgaacctgatctccatagggaaaacagaagaaaacattgaagaggactatgctaatgtcagaagtctgagaactcagatgattgggagaaattgtaaatatgaagatagctttcagcgtggagaagcccaccaccgaattccagaatatgttgttaacaagggcatgccttttgcaacagcagtgtatgaaagcaatgtgtgggcaagaggcatccgtgctcactccccttcacgtgtgcatctcacagatgaaactggagcgaaaccatttgagaataagataggatcttactatgtatgcttggctggcctagagcttacatagttcctgcctttgcctccaaagagttggaattaaaacttacactacc

SEQ ID NO: 74 - DNA, 1941 bp, Mus musculus
gtcaacaaagactctcttgaggtggcatttgaatgaggagtgagcaagtgtcctgggcaagctctgggtcaccagcatcctcaagagatggagcaaatcaaaggcagagaccttgggaactctgatcattcttctgtttgtttgttttcgaggttgggtttctctgtgtaacctcggctgtccaggaactcattccataaaccaggctggcctggaactcagtgatctgccagcttctgcctcccaagtgtggggattaaggcaggttgtcacaacttttctgggaaggatgaagaggtggcattcgagagcactatgaacttctctgatatttaccactctgatgaagagtatttcaggaaactcaaagacctgaaggctgtccatgaagaaaccatgtcaaaattagagaaaatgtaccaggacaagctaaatataaaagacatccaggcggggttcatcagggatgggatcagcgattcgtcttcgagttctgcatcggaaaagagctgctcacatcctgccttgtcagtgacctcactttcagagcctgacctagacgggtcgtcctccttgtccacaactactgatgaggggttgcccgacctagaggaaaagactcccggggaaagcagcgcaatggtccatgcccaggagctcataaacaacatgtggaacgacttttctgttgaagattatattcagtatgactcagactcccgaacagctaagaaaaaaaggaagaaagctaaatccttgacacccaagattacagtgcctgtaccctttgaaatgacggtaagagagcagaatcggagagagaaggccttgagtgctcggtcagatctggaaacaaagctgctcaagagggacgaggacgatgcagagtgtaagaagaaattccgagccaatcccgttccttcctgcgtgctccttcccctttatgaggatctagtcaagcagagtgaggagcgccggaagaaggcccgggagaggaacagagctgcgctcctggcctccctgaagccctttaagttcattgcgagggaggaacagaagcaagcagtccgcgagaagaagctgagagacctttttagggctaaaaggaaaacgaatcagtttaaagccaaacctgtgcctcgttttatttacaggccagctgcgagtgacaagccaaaggaagaagagctctatggggacagcaggatgctgccaaaggtcagagatctgttacagaattcgccttggcccagtcggtcagcttgcagacgtttcagggaccccagaagtcctgcaaagcccaggggtaaacacaggcgtaggtgcctgaggcgtgatggagacttagaaaaatggaaggagcccttctctgaatacagctttctgaaatgcccaatgctttgtgaagagtgttgtcttcacgaatccccttgtgactctgataaaagacagaaactcttggcagacatcagagcagatgaagaaattttgagagaaacacgcaggccgggtcggtctcctaggcgcaagtcaccgggaagaagctcgaacccaaagcccaggcctcatgaatgcagcccaccgatgcccaccgcgtcttcccgagggcgggagcaagccatcagaaggagtgaaaaggccaggatgagagaatattggcaagaactggaggaacaagaggaaaaactgcagaagaggccgatgttgtttgaaagagtcacccaggttgtgtttattggttagggccatcaccagctttctgtttctcagtacttctggcctccacctttgtgctccgtcttacggtgtcctacagttgccaagacatgatgtttctggggcggcttcatccagtccaccaagaaagtaatttcacttaagatgtgacaacgcttgtagctcaataaagaacatgtcactaaccccaaaaaaaaaaaaaaa

SEQ ID NO: 75 - DNA, 911 bp, Mus musculus
ggagagccatcaatcccccaaactgtaaacatcaaggacaacaaaattctgtctttctcaaaggcctaaggtggggtcagccacaagaagaggtctgccatcacttctggcaagtctcaaagacaaagatacccagacccctttgagctttagagccccagcctgtctccccagcctactgacaggtcttgagcatcaatggagaatgatgatctggggacactgttgcgttggctgctctgttgttttcaccttcttcccaggctccctttcagacagcatcatgccagggttgcgtttccctcaatgcttgagaataaagatcatggatgcagcggtgatatggagggacttggacatccaccttactccttcctcttctccctcttggatgcataggagatatggaggatcctggatgcccaccttattccttcctcttctccctcagtgtcctgctcccaccttagcctccagtgactcagtgagtgtggtcctatggagggaccaagccagtttcaaatcctggggtgtgagtccctccagcttcagtccctcatgtgttgtggacacccaccttgcctccttggctgggtcctgcttcctttctgaagtatctgttgggttgaggaagaggagaattgtccctcacagttggatgggtatgatgagaatagatctgagagaagttatagggatggatatgatcaaaatatgtggtatgaaattctcaaggaattaacagaagtattaatttaaaaacagggttaacacggtgccatatctggctgataatgattgcttggcctttagctgtttgcaaagaagccatactgacctccgctcccctcttacatttgaaattatttcggatgaaataaaaaatagccccatggatgatttctctcaat

SEQ ID NO: 76 - DNA, 686 bp, Mus musculus
gagtggcctctagtgaccagtcctgtgaccagtcctatcatgggaaacagcagttcccacaagaggaccaaagcacccaatcaggccaacaaggacaggccacctgacatggacaaagcccgtcacaagcagttcttcagccatctcaagaggaagaagccaagttggcgagaggctcctgaccctgcccgtgtgggtgagaacccccgcatcaaggctgggaaaaccaagatcgtgctgcttttcccgctggacaagcggcagcagctggccgaggcagcggcgggcccatttgtgaggccggtgcggccaactgaggacccgctcggcgccccaacgtgcttcccagcggtggcgcctatgctacgtggggctggcgacggcgtggacaggcgcgaaggcgcgcgcgctcgggagatgaaaaggatcctggtgctgctgctgcagctggacgcacggctgcaggaggaggggcgtcgagtgggaggcaggccggggggcggggccaaggtcccgcagtgctggcagccgctgtatgcgcacgtgctgacccaacgcgatgcctgtggtgaaggcgacccccgcgaggagcagccgcgcaagcggcgccgctgccctcgcccgcggccctgagtgcctggcacgacccctagcgccaggactctgctcaataaagagcacatagc

SEQ ID NO: 77 - DNA, 1191 bp, Mus musculus
ccgcctctcagtttgcgcaccaggacaggcccgccttgaggagggtgggagttcccgcagccgttgacggttggtctgtctcatgtatcttcaactggtctgggaattctgaactttctgcctccatcaagttctgggattagaggcatgcaacaccttaatgatggaagagctagagcaagacctgttgctgcagccatgggcatggttacaacttgcggagaactcactcttagccaaggtgtctatcaccaagcacggttatgccttgctgatttcggatcttcaacaggtgtggcatgaacaggtggacacttcggtggtcagccagcgagccaaggagctgaacaagcgcctcactgcgcctcctgcagctttgctctgtcacctggatgaagcacttcgcccactgtttaaagattctgctcaccctagcaaagctactttctcctgtgaccgaggagaggagggactgatcctgcgggtgcagagtgagctctcgggtcttcccttcagttggcatttccactgtattccagctagttcttcactgaaattgccagaggcgtgtgctgttggtgatggaaagccatttgccatgagtctgcagagtctgtatgtggcagttacaaaacagcagatccaagcaaggcaggcacataaagactctggagagactcaggcatcaagcagcacctcccctcgaggaactgataaccagccagaagagccggtctccctctcttccaccctctcagagcctgaatatgagcctgtggctgcttcaggccctatgcatagagctcggctggtgaagtccaagaggaagaagcccaggggactcttcagttaactctccatgtctcagccaccacgaagagagcaaaaccgcttcctagcatcacctggaaggagcttgcatggcagagcatccctcagaggcctgagtttgtgttgacaggccacctggatggggactttaccaggggaagcctgactccaactcactggcattccggatatgagtgacaccagctccttgcttgggtagtgttctttctctagaactagcaccctatggcaaacttaggtacatgaagcaagtttacaaagaggcgcatgcccagaactcctggctgcctttcacaggggtctctctctctcaacacagaataaaggatgctcacactc

SEQ ID NO: 78 - DNA, 1477 bp, Mus musculus
gttgaaggagcccttgccgagtggaaagaagagaagcaccaagttagagagcctgagcgatctggagagggctctgatggagagcaaagagactgcggcagctatggcaactcttggggaagctcgcctacgagagatggaagctttgcagtctctcagatttgccaatgaagagaaattgctgtcacctgtccaagacttagagatgaaagtctgcttgtgtcagaagactccagccactcccatgattcagtgtgaactctgcagggatgctttccatactagttgtgtggcagcacccagtatttcacaaagctcccgaatctggctttgtcctcactgtcggaggtcagagaagcctccattagagaaaattctgcctctgctggcctccctacagcgtatacgagttcgtcttcctgaaggagatgcactccgatacatgattgaaagaaccgtgaactggcaacatagagcccagcagctgctttcttcagggaatctaaaacttgtgcaagaccaagtgggttctggactgttgtctagcagatggccagcctcagcaggacaggcatcagcaacagacaaggtgtctcagcctcctggcacaacatccttttcattgcccgatgactgggacaacagaacctcatatttacactctcccttctctactggacagagttgtctccccctccatggtttgagtccagaagtgaatgaattgctgatggaagcccagctgctccaggtatcccttcctgaaattcaggagctttatcagactctacttactaagccaagctctgttcagcaagctgaccgaagttcaccagttagatccagcagtgagaagaacgattgccttcgagggaaacgagatgcaatcaacagtcctgagaggaaactgaaaaggcgcccagaaagagaaggccttcctagcgagcggtgggatcgagttaaacacatgcggaccccccaaaagaagaaaatcaaactgagtcaccccaaggacatggacagtttcaagttagaaagagagcgtagctatgacttagtgcgtaatgctgaaactcattccctgccctcagacacatcctactccgaacaggaggactctgaggatgaagatgccatctgtccagctgtgagctgcctgcagccagaaggagatgaggtggactgggtccagtgtgatggcagctgcaatcagtggtttcaccaggtctgtgttggtgtctctccagagatggcagagaaggaagactacatctgtgtgcgctgtactgggaaggacgcaccaagccgaaagtaaaaacaaaacacacactcacttcatgtaattcaggactccaataaagaagatttcctcaatctcagcaaagctacaggactggggtcgagccagcctgtacacggtgctatttctattccttatgggatcatttttccagaactcttgaaaaaaaaaaaaaaa

SEQ ID NO: 79 - DNA, 1367 bp, Mus musculus
ggtctccattggccagctttacccgccctgcgccgacatcactaggggtacgcccggagttatcactcgccgggctcttactggggctagagagttgggcggggtgcacgagtcttcacacacttgacctactgagctccagagcacaactatggaggtttttgttctttggaaagaaaagcccttgaacttggtcctcattttatcgggtccaggactccctagcagaaaacgtggcctgagctggagaagcaactttagtgcctgacgttgctgctggggattctggcccctgctgcatttgaggtcccagcaagcaactgccggaaccagagtaaatcagcaggctcaattttgaatttacaaacagtttattcaggtcaccgggttttgttttggttttttttgtttttttggggtttttttgggttttttggtgtgttggttcccactggtacataagtcacacaaaagctgtgcatgtactaagcccatatgtgcgtgcgttaagcccacatatacacacaaatgattgctttcctagttcgtgttcacattgggcacataaaaaaaaaaaaaaaaaactcaatagattctttgatttagggaagctgagtgtgtgcttagactcatttgcctgtgctttcacgcctcagaccccctgagaatttattgtgctgtggtgcaagacgttaaagaacctgcggttatgaagagtctgaccacattcaaaacagtttattaatctgttttgcggcctagagctctaacgtggttcagatggtaggtagtagagctagagttagttacttttgagttccactctgactccagcaaatttgaggacggtgaacaaatgacccaccaagatttcttagacttgatcaaaggaaagttaaggatggagaaacatggctcagcagttacaaacataagctgcgtttgcacgggactggagatctcttcccagcaagtggatcagaaagctcacaaccaagtccaactccagaaacctacctgcattttggcttggtgctggtttgagagagagagagactcttgctggattccacgtagttttgcagctgaggacaaccttggtctccccatgccccagcctctactattgagattgcagtgtgtacccccattcctggcccagaacctaaaagcctggcaaaccagactcaattctgagctcacgttaaaggaaggaagagagaagaaactccacaaacttcccaaccaacacacataccacacatgcattttctgttttattggctattctctcaaggtcctccccttccccccccctctccgtcctattttgggggtgtagtcataaagcagtgctttcgcttacg

SEQ ID NO: 80 - DNA, 434 bp, Mus musculus
ttcaaagaaagaacatattgcatgctgtacaatctaaacagatttttcacttataacataaaaacaatctcaaaaatgtaactttagataaagatgcagaaggtcatatactgtatgaccacctcaagtttttaaaaagtggaaaccttgatggctgtttctcttgttcatgtgctattgcgggaagaactggaagctccaagttccatcagctgccacaaggttaggaaaattaaaagaattaagtgtgtgattaaatttttaccacttatgctttgaattcaaaactcagttttgaattatgtgaatgtattttataatgtaattttacaattataaataccaaggtaaacaaagaaggtaataaactataaactgaacttaaaatctcatcagtagatagagcatggctgtggcaccctcttggtcttcag

SEQ ID NO: 81 - DNA, 642 bp, Mus musculus
cttcaaattttaggtcatttatttaagtgttttttaattaaaaaaaactgatatataaggcaaatgtgtacatattaccgggctacagtgtgtgaagttttcacctgcttttatgtaagtaatttctccaatctccaaactaaacatcacctcctatgacacagccttttcatggagcataaaccttggcacagattattcataaacatgattttgctttgtttcccagacagggtttccctgtatagctctggctatcctggaacacacactctctttgtagaccaggctagccttgaactcacagagatctgcctacctctgcctcctgagcactgggattaaaagcgtgcaccaccaccgcctgacagtaagcatagtttttatgggttaaaaataagacaagagcaaagctgagaggtgagggggtgaggaggagagagagcaggtggggtgagtacaggcaaagccatgcatgagaaacaatgggacccagaagatgaagagtgagcaccatcaacaaacaggggactgtgaggaagtgaagagtgggtgacaggtgagtaggtacacacacccatgtatatacatgcacacatacacatgtgcacatgcgtgctgatttaagacaacctctgggag

SEQ ID NO: 82 - DNA, 3786 bp, Mus musculus
tatttcctgctgctcagcgacagctgagcccctcgcgggcccaggcggcccggcccggccccagcactgagtacaaccagcacgaagccccccagcacccacaccatgaaggaggaggcctttctccggcgccgtttctcgctgtgtccaccagcttctactccacagaagactgacccccggaaagtcccacggaacctgcttctgggctgcgaaaatgagcttggtcccatcaccccaggaagggacatggagtccaacggcccatcacaacccagagatgaagagccccagaccccaggctccgccacgaaggtgccactggctgagtacaggctatgcaatggatctgacaaggaatgtacctctccaacgaccagggtctccaagaaggatgctctcaaggcacagaaggagaactatcggcaggagaagaagcgggccacgaagcagctgttcagtgccctgactgaccccagtgtggtcatcatggctgacagcctaaagatccgagggaccctgaagagctggacgaagctgtggtgtgtactgaagccaggggtgctgctcatttacaagacacccaaggtgggccagtgggtgggcacggtgctgctgcactgctgcgagcttattgagcgcccctccaagaaggacggcttctgcttcaaactcttccacccgctggaccagtctgtgtgggctgtgaagggccccaaaggcgagagtgtgggctccatcactcagcccctccctagcagctacctgatcttcagggccgcttctgaatcagacggccgctgctggctagatgccctggagctggcccttcgctgctccagcctcctgcgactgagcacgtgcaagcagggtcgagatggggagcaggggtcctcgcctgatgcctctccctcttctctctacggactgcccacctcggccaccatcccagatcaagacctgttcccgctgaatgggtctgccttggagaacgatgcattctcagacaagtcagaacgagagaatgcagaagactcgaatgccgagacccaggatcacagccgcaagaccaacgagagtgggagcgacctgctagacagccctggtgggccatggaggggaactacctatgtggaacaggtccaggaggagctgggagagctggacgagacttcccaggtggagacagtgtcagaggaaaacaagagcctgatgtgggtgctgctgcgacagctgcggccaggcatggacctgtcccgtgtggtgctgccgaccttcgtgttggagcctcggtccttcctcggcaagctctctgattactactaccacggagacctgctctccagggcagcagcagaggatgacccctactgccgcatgaagcttgtgctccggtggtacctgtctggcttctataagaagcccaagggcatcaagaaaccctataatcccattctgggggagacttttcgctgccgctggctgcaccctcagaccaacagtcacaccttctacatagcagaacaggtgtctcaccatcctcctgtgtctgccttctatgtcagcaacaggaaagatggcttctgcatgagtggcagcatcacagcaaagtctaagttctatgggaactcattgtcggcgcttctggacggcaaggctaaactcaccttccttaatcgcaaggaggagtataccctcaccatgccctatgcccactgccgagggatcctctacggcaccatgaccatggagctgggaggcaaagtgaacatcgagtgtgagaagaacaacctccaagctgaactggacttcaagctcaagcctttctttggaagcagcgccaacatcaaccagatttccgggaagatcatgtcaggagaggaagtcctggcacgcctcactggacactgggacagagatgtatttatcaaggaagagagcagtggaggcaccgagctcttctggactccgagtgaggaggtccgcaggcagcggctgaagcggcacacagtgctgttggaagagcagagtgaactggagtctgagaggctgtggcagcatgtcaccagggccatccgtgagggtgaccagcacaaagccacacaggagaagtctgtgctggaagaggcgcagcggcagcgtgcccgtgagcaccagcagagcctcactccatggaagccacagttgttcttactggaccctctcactcaggaatggcgctaccgatatgaggacctcagcccctgggacccgctgaaggacattgcccaatatgagcaagatgggattcttcatactctacagagggagactatgtctggccagacaacctttctggggagtcctgactccaggcacaagaggcctagctctgatcggcggctccgcaaagccagtgaccagccctctggccatagccaggtcactgagagcagcggctccacacctgagtcctgcccagacctctctgatgaggactttgttcctggtggtgagagcccatgtcctcggtgcaggcgagaggtacaccggctaaagatgctacaagaggccgtgctgtccattcaggaagctcagcaagagctgcataggcacctttcgaccatgttaagctccacagtgcgtgctgggcaggcgccagcccccagcctcctgcagaatccccgctcctggttcctgctctgcatcttcctgacgtgtcagctattcattaactatatcctcaaataagagcccttggaatcagcaaggtgacgcctgcagaactccctcctaggcacccagcactttacaccggcctgcagaagcagtggggcccacaggcatggccagtgggacagaagggtcctcgcacaagaggatgacaggtggggcctgggctatgagggtgctgtgactccagctgtaggaccctccagggagcactggcctcttctttggagccctccacctagtaccggccttaacgctaaagccaaatgcagtttctgccctgcagtgtgcccctggtaatctcaagttgcactcccaagccagcccccacttgccatacggcatcagatctgggggtcaggagggcctgtgcaggctttggacagccacttaccacagcacaggagagagtgaggttgccaggagcagcaggaaggaagactccaggattccccggagctctttgggtggtaatgttgacttctggacaatctgcccaccttgtgctcacacaagcatggacaggctgtagctactctggtgaggacactgggacttttatcctgttgttaacccgtttccacagaagcctgttcaggtagttacttcacctacatctgccctacagccagaggagcccacctgtgccacaggagtgccctggccaactgcagtgtgagtttgtaagcaagagaagtgcccagaggctgaccccaaaggccagggaggcccaagcttgccactcttccctgaccaatacagtcttcccattctgttgacattctgactacatagaattgcaatatctgaggcagctatgtgcagtgagcagcctctgcatccagcccctgatcctatgtggatgacgctcttcgtgtgcgtgtgtgtgtgtgtgcgtgtgtatgtatgtgagcacctatgcgtactcacatttggagccttaatacttagttggtgccatctccattgtatctgatcctttcattttccaagttttgtatccatttgtctctgtccttccccaatcctgggggtatgtctgctccatgccttgaaataaatggaaatacatgt

SEQ ID NO: 83 - DNA, 1935 bp, Mus musculus
aagaggtaatccagtgagcacacttcactctggaacaaagctactgggcttctcttctggttctgactcacagatgtttgccccaacagatgccatggatgatgggcatcaagagtcagctctgtacgatgggcactacgagggagatttctggctcttcaacaattccagtgataacagccaggagaacaaacgcttcctaaagttcaaggaggtctttttgccctgtgtgtacctggtagtgtttgtctttggactgctaggaaactccctggttctgattatatacattttctaccagaagctgaggactctgacagatgtgtttctgctgaacttgcccctggctgacctggtgtttgtctgtactctgcccttttgggcctatgcaggcacctatgagtgggtcttcggcacagtcatgtgcaaaactcttcgaggcatgtatgcaatgaacttctacgtgtccatgctcactctcacctgcatcacagtggatcgtttcattgtagtggtccaggctaccaaggccttcaaccggcaggctaagtggaagatctggggccaagtcatttgcttgctcatttgggtggtctccctgttggtttctttgccacagatcatctatggccatgttcaagatattgacaagcttatctgtcagtaccacagtgaggagatatccactatggttcttgttatacagatgactctggggttcttcctgccattgctcactatgattctgtgctactcaggcattatcaagaccttgcttcatgctcgaaacttccagaagcacaaatctctaaagatcatcttccttgtagtggctgtgttcctgctgacccagacacccttcaaccttgccatgttaatccaaagtacaagctgggagtactataccataaccagctttaagtatgccatcgtagtgacagaggctatagcatactttcgggcttgccttaaccctgtactttatgcctttgttggcttaaagttctggaagaacgtctggaaacttatgaaggacatcggctgcctctctcaccagggagtcccaagtcaatggaagtcttctgaggacagttccaagacttgttctgcctcccacaatgtagagaccaccagtatgttccaattgtagtaggccttgccacacttagagaagttaataacagaattctaggagcatggctgtatcatttggatgcaacaagaaaagctttgcttatagcatgtggagtatcatggaaaagtcactgaacaccatggctggtacacaaaacttctcagatataaatataccctattcttaatatctaagcctaatgctcaaaggagaatgagtatcttgagattttgaagcactttctctctttcatcctcaagaatgctgaaatcaaggtcatgacggttaactctagagatctcaagttttctttttaccaagtttgggcctaaaagttgaagagctgcatcaacaaagatgttgctggcagataatgttcagggctcttgagttcagaagattcttcagtgggcaagcagttgagaattgaaaaggctccatacaaatgctgcttgaatgagaccaggttctgactcatccaggggtctgtctgacttttgtatgggtggatgcttatgttttactggaattgtcttgtaaagtgcagcaatatgggactgaaaacaggccagaataaataagctgaatttcagtggtccatgtaatgctagaaaaatgtataaaacagagcttaagactttaacaaatacaagaggactctggtggctttgctcatctaaaaaaaaaaaaatgaaagaaattgtgacacatactatgtacacacaaatatatcaagcattttgagtttcatggctaagaaataaaaccttttaaatgttaaaaaaaaaaaaaaaaaaaaa

SEQ ID NO: 84 - DNA, 1016 bp, Mus musculus
ccgagaattcggcacgaggcaaagcctgctccaaagaactcacccaagaaagcaggtgttccagcagccccgcctccccctccccctcccctggccccgccccttatcatggagaacctaaagaactcactctcaccagctacccagaggaagatgggagacaaagtgctccctgcccaggagaagaactcgcgtgaccagctcctggctgccatccgttctagcaaccttaagcagctgaagaaggtagaggtgcccaagctgcttcaataggacaggcagccgggcattggtaccaatgccatgactgcccagactcttgttccagggctacacagacccccaccaccccaccctggctgagctgttgcagctgtccctgtccaccatgggagagcatgagacctggaccacgctcgagggaggacacctcatctcttctccctttccttttcttgtctctgaggcccttcaaaaattgctttgaaacctggagctgaagtgtccagacaagaggagtcctttaagcatgtcacagagaagatggcactgcccagagcccatgtagcaggcatgctgccaaaggcttatgatgcagaaaagatgtctcccagggaccacatttggaccccagcctcactgtccccagggccaaggattcaggtctctgaggagcccttgggcaaaagttgctgggccaagtggcactctatgggacagtggtagaaggctggaggggatgaaagtccaaaggcaaagtaggagctcagacgatgctacaaaccctccacctgatatgcctgggcagcaggcatggttggacagtgcctgaaagagggtaggctccagatgggagtagaaagacagacagacagcagctggacctgaagggttgatgccaaagcagacattttcttcacatcacctgctgctgtataaatagcatatatatctgtttttccataagattttgataatatatacaaacctttagcttcgaaaaaaaaaaaaaaaaa

SEQ ID NO: 85 - DNA, 573 bp, Mus musculus
cctttgggtttgtgtgttatcggtacagtcaacatcagagtcagttactgaccccaagtctgatgccttgggactggtgtcaggtccgcatcctgaactccccatttgtccgggcacgtcctcaccatctacctcaggatgcattctcctcctcttcaccccgacctctgctgaggcctgtaaactgggagtaacttgtgctgtcctactgagtggggccttcccgtatgtcctgagccttctgccattccaccttcttaatccatagttcagttcttcttcaaagttactctctacagtagctttctgggtcaaaaccgactcagaaggcaagctagtctcactatctagggtttggcttctggcgttttcctgagaaagcccagcagaggagctttgggttttaggaggtggccttacgcagacagcgcccatttgcctgctctgtatgctttttctttgttcaaaactggaaccccctccagaattcaagtctgcacttgcagcctgactgggattctctgcactatcttggtgttcaggctcagggagcttgttcctgcaggcaggctg

SEQ ID NO: 86 - DNA, 1387 bp, Mus musculus
aagaattcggatccttgttcaatgatggccagcagctctgcatatttactctgaggcacctggctatttccagttccctgggtgtagcctagcgatggaggcccatagtcactcagcagctggcgatattgggaggaggtcgccatgctagtagagggagttgctggattccaggctgagggccttgaagaaggtactggaagactatgaagcgttccggtcaacagaggagagggagagcaaggagcttctaacagaagcagatggcagcagagaaagagaaggtaggggcggagttccaagcgctgcgggccttcctggtggagcaggagggtcggcttctaagccgactggaggtgctgtcccgggaagtgacacagaaacagaatgagaacctggcccagctggagggtgagatcactcagctgtccaaactcagcggccagatccaggagacagctcagaagccggacctagacttcctccaggagttcaaaagcacactgagcaagtgcagcagcgtgcccagctccaagccaaccacagtctcatctgagatgaagaataaagtgtggaatgtttccctcaagagtttcgtcttaaaaggattgctgaagaagttcaaagaggatctccagggagagctggagaaagaagagaaagtggaactcactttggatccagacacagccaacccccgtctcatcttgtccctggatctaaagagcgtacgtctaggacagcgcgcccaggacttgcctaaccatcctcgccgctttgataccaacacccgcgttctggcatcctgtggtttctcctctgggcgacatcactgggaggtggaagtgggctccaaggacggctgggctttcggtgtggcccgggagagcgtgcgtcgcaagggcctcacgccttttacccccgaggagggcgtctgggcaatgcaactcaacaatgggcaatactgggcggtgaccagccccgagaggacacagctcaactgtgggcacttgtcgcgggtgagggtggcgctggaccttgaggtgggagcagtgtccttctatgcagtggaggacatgcgccacctctacaccttccgcgtcaacttccaggagcgagtgttcccccttttctctgtttgttctaccggcacatacttgagaatctggccttgaagagctgtcaggcttactaggaggggacagggcagcggtgtatctcggtgagaccgaggtactttatcttggaccttccttcacacccctacttctgctggccaagaagcttgccagagagcacaacacaggcgctgaagactgattgagcaaaagaggccctgtggggtaacttcccgaatgcacagcgaaagaagatgcccttgggaccc

SEQ ID NO: 87 - DNA, 680 bp, Mus musculus
ggcgtggaatggctgccattcctgtcaagcattccttgtcctcgtcccgcatggaaattagagagattgcaagcagaaccggcagggaactgctaggcctctctgataatggtggaaccaaaacagagggagcaccaagggccaaatcaaaaacccggaagcggttggaagaaagccaaggaggcctcaagccagagactgtgaggtcagctagtagtgacaggatcccatcaggaattttggaaagtccggcatcagaagccaatcccgagggccacaaccactgggcaagttctgagcaggacgctggggtggataaagagggcagcccgggctcaggcagcagccccttccagctcatggcctcctcagaggaagacatcattgacttgaaatagagtctatgccctattggccatccttagttttcttacgcaaatttatactgttcaagcagctccaacgtccagtctcaacacagcgcgccttcggccaggcagcgatccacggaccaaacctcctgcgccctcagccggtgggtcacttctccagtgtccagtgccatctttctcgaccctgtttctttccattcaagaaccgtcggtccccttgtaataaaggtggtagatttcattaaggttttagatcaaaactttgaataaatcaaaaacgttcattct

SEQ ID NO: 88 - DNA, 290 bp, Mus musculus
agcctgccccgaacgggagcacggcttatggtaccacacgacacctggctgctagatacgggctccctgccacctgctctacctttccctactcacttcgccccaatcgctcacccctgcggcccctgattgagatggttgtggcaagggacccttctgctactctgggtcaattcggcacatatttggcttagctagttcgcacagatgctctgcaggtgctatctaaacttggctgagtcagagtttgctggggcttactactccatcaataaagtttcccttgaacc

SEQ ID NO: 89 - DNA, 542 bp, Mus musculus
ggtatatgtgtgcatttaattggaaatgaaataaagcagagattgttcatgagagagaacacttttaaaggacatataggctagccaatgtagaactgtatttctgcctttgggtgtacatagaaggagaggagaaaagagggacactaggaacatggagtggggtttagtgacagagaggagggggcaacactaaaaggaaggagagaagcccatgaatgcttttctacaattccatcctgatcacagcttactgccatgactggttttgggggtttttttgtttggttggttttactatattaccactgagaatttccctgctgcataattatgtatgacaaacagtgcccatttcagtcctggggagcaaacccaggctctaggatacggtaggcaagggttgttagccctcagcaataccaatcaccctgcatgaaaaaagctttcctttcgaagctcctagactacctttcctgtgtgaaaattgtaaccaatgaataagactagacaatcaagagcaaaattaagtagctaaaaag

SEQ ID NO: 90 - DNA, 200 bp, Mus musculus
tctccatcccatagcgtaggcattcacagcccacttgagttcctatctaactgcccagtacactcgcagccgggtttttctctaggccagaacctggtcttgtgttctctctgttctgttattaaagagcaccaaatagtaaaaaaaaaaaaaaaaaaaaaaaaaaaaaaaaaaaaaaaaaaaaaaaaaaaaaaaaaaaa

SEQ ID NO: 91 - DNA, 2345 bp, Mus musculus
cggacgcgtgggcggacgcgtgggctgcccactacaggagacagtgcctggacccagctgccacggcgagacggagtccatagctggcgaggccggtgagcagggcgaggccaggccctgcccgaaaggaccccagagtccttcaccggcccccgagctccagagcccatcaggctctcctgctggctccaccatgacatcagagtctacatcaccgccagtggtgccacccctccactcccccaaatcccccgtctggcccacgttccccttccacagggagggcagtaggatctgggaacgtggtggtggcattgctcctcgggacctgcccagccctctgcctaccaagcggaccaggacatactcagcgacagctcgagcctcggccggccccgtgttcaagggcgtctgtaagcagttctcccgctcccagggccacggcttcatcacgcctgagaatggctccgaggacatcttcgtgcatgtttctgacatcgagggggagtacgtgcctgtggaaggagacgaggtgacctacaagatttgtcccatcccccccaagaaccagaagtttcaggctgtggaggtggtgctcacccagttggctccccacaccccccacgagacatggtctggccaggttgtgggatcctaggcaggtgggggtatccccacgaggaggcaggcagcagccagtctgtgcccccactgtgctgctgacccagcccttgggtgtgcttgtttgtccgcctgtctgtctgtgcttgtggctgtgaatgtgtgcttccacctgtgacccgtgacttgtatgatccggcctagggttggacggagtgcagctaccaaggcgtgtttctccttcctcccaactctgccacgtacacacaccttctcgccctcttgcccactatctatacactgagtctctgtgggtctgtgtcatgttcttgagaacccagggggacccctctcctgtgagcctgttccttactgctgtctccggtacccaggcctgtctgcttgtgttcctgtctcctgtgctggacctgggttatgtaccacagcctgggcccttcctctcacaagccaggcctctgagtactttgtaggggtctcctttagggaggaagagggcaaaacgtggaggttcctggccaatccctgccataacctgcccagttcatcttcctgtccccgcctgtttggtgccctgagaacatggctgcaagcaggagggaactttagcactcctgttatgtaggccagtcctctctcctcagctgtcagatgatctttgaaccccacagagctgaggaagccaagctcactcactccctgaggtgaggcggggatagggtttccttccagcttgctcttctacccgggatgctcaaacctcacgaatgctctggcccattgctggccatgacagcagctgaggatgcagcaatggactgacatgtcacctcaggcaaggccaggtccaggcacccaaaggatcggtcctcagccagggagaccactggctttgcccctcccaccccccatgagatcctcttcccagagctatgcaatggctctcataagcccctgacaggtcagcagctgaggtggctcttatctctcttgtccccaagtgtgactgtccctcttccctggagtccctttggagctgtgtcccttctagagagccagttacttaaccagaggataagtgaggtcacaggctcaggaagggcctggcacaatagtgacctttatgagacccagcccagaagtaaaatgtgagcacagatagccagggtgaaggggtcagtggttgcgaggtagccttgtaggcattccaggaccacagggtagtcatttggggcatttgcaccccaacttgtcctagtaccctttgcacatgacccagcagcctagagctgctaacaagtgctggccagtcctccatcctgggaaggacctgtctgataccccactgtgagctaggcttctccagcaaagcctatccctggagaccagtcctcagcaaccttgaggaccagagttcaaatctccagcaagcctgtaacccagaactgtgttaataaagacacaggcggatcctttgacaaggaaccccagggccatcagccctctgttgtgagcaggtccttagcagtcatcaccttgaggctccccgagtgatagggacaacagacctcctccctactcttgggccctgcagcgccaagtcagaaacttccccactcagaccccagccacggattccccatccctcctgacactggcaataaactcaactgtgacccaccttgcccctgaaaaaaaaaaaaaaa

SEQ ID NO: 92 - DNA, 2345 bp, Mus musculus; identical to SEQ ID NO: 91

SEQ ID NO: 93 - DNA, 2967 bp, Mus musculus
cttttcctccctgttgtccctggccttgtccggagtcgggctcataccatgtcggtcgcactcagcaacaggttccaaggagggaaggcgttcggtttgctcaaagcccggcaggagaagaggctcgaggagatcaatcgggagttcctctgtgaccagaagtacagtgatgaagagaacctgccggaaaagctcgcagccttcaaagagaaatacatggagtttgacctgaataatgaaggcgagattgatctgatgtctttaaagaggatgatggagaagctgggggtccccaagacccacctggagatgaagaagatgatctcggaggtgacagggggtgtcagtgacaccatctcctaccgagactttgtgaatatgatgctgggcaagcggtcggctgtcctcaagctggtcatgatgtttgaaggaaaagccaacgagagcagcccgaagccagctggcccacctccagagcgagacatcgccagcctgccttgaggacccacccggaccttccgggctgccatccctgcccctgcctctccctctgcgctctgccatcttgactcattgtgttaggtctcctgggttatgccccagtggactcattttttttttttctctatgtaagcacatgttacctgacttaatgaggctgggaatcccgagcctcaggcccctctgctccctgctgctctgccctctttgtacaaaagggctaacatcaaaccaaaaactggagagggcagggaggctgcaaacctcgttcccatgtttgaagagggcctgtccgtcagttcatctttctcagcttctaaattaaattcaggctgcaagctgctctcggaagatccagagcaggcacagagctccagggctccctagtgtcttagggacatgcttccagtgccgctggaccttctagcagcggctactcagtggctagacacacaactgattcccttttgttcttgcccttgtccattctcagcgacatgacgcaaggtggggaggaaagaacaacctttgggtacttcagaggaaccagaaggaaccgctcctttacagacagctcagagggacagtgtaatggcactgtcccttgctagagcagtagaggggtttggaggcagaggtgaggtcagtggtgtgagggagtcctactttcagggtggatgctgagggcaccagggtagaagtggagtcaagtgttgaacctcaaacagagaacaggctgtctgattgcacagtgccccaatccggctatttactgtcctgccctactctcccctcccttcactccctcagttatttatcgagtgtgtattacaagctttaagttctcttgctttgtctccatgtgtgctatgtccaactcctagctcccttttcaaatccctcaagtcctggagcttggggattagatggaggtaacatggcagattttagctgggccagtccttccatttcactgctggcctccaggggttaagtgccttgctgaaggttggtgggggctatcagagagtgtggactggagacccgctctaggctgcattggtcaaaggaaagggtagagagcagcatttcccagcctgatacttgaggaaggtgtggtctccacggaacaccttgggtcaggactcaccctcctgagggcctccaggttggcagtgagatttcagtaagcaccaagcctagctttgcagattgtcttccttacagcttcctgactggtcttcagagaccatttccaagaattcatgcagcaaagtatcaaatgtcttacccgagtggggaacctcagccttgaccctgcttgtgttctggaaccatttactctgggcactcaggacgagacagtcactcatcacacatatttatcaagcacctgctcaatgacacgagtccagaacccggcagtgaaatggactgatgtatgaaatttatgtctactggggaatcactcccagccaatctagccaatgactatgatatggagtgggggggagtgcaagaggtgagtaccatgtagtcccagggattccagctgggctcataatttggcaagtgtcagaggagcctctgtaaaaccttaagtggaaaagacagggaagcgttgagctaatgtgcttttcctgtggctcttgttccacagtccaatacccagggtgctgttcccacagcagtgagagagagagagagtgaagcaaacagggcatggaatggttagctccagttcgtcctctggtctcaaccagttcagttcaggagagagatcatttcgctatgactggctgattttcagccctaggagctgcttcaaatgcacagtctagttgaagtttaaaccccagcattcctccctataaatataaaatcctgtctaccctcaccccatcctttgacttatttttcttttaagattagcatctctgcccccatttcctcctgccttccttctctgagcgggctgggaccttggactgcattgggtccctattctatgtgacagaggaaggaagaatcagccggctcagtgggtccacaactcatgagcttacacaccacctccataaaggagtgtgccactgacctctgcagagcacagaaagaggcagtggtctgaagatcaatctatgggaagacttaagaatgaccctttaatggaggagttggcatatatttcaagttgtgtctgttggttccagggtttttaacctctctagttaagggcttagctttcttgggacatcggctgccttatttctgaaaaagaccaaatgtaactggtgtaaccagcagtttggggattgccaagtatggctttgccctgtgactcaaaagatgtttgtaaggtagatttgggtgagtgccattattgtgtgcatgtgtgtatgtatggatgggatgtggtctcctgcagactgaaataaactagagcaatttaaaaaaaaaaaaaaa

SEQ ID NO: 94 - DNA, 972 bp, Mus musculus
cgtagccccctagggtttaacataaacactgtttggtctgagatctacttaccataaatcagatggtggcgccctggggagaggaggcagatggcatgtctcagaccagatgcaagtcccactcctcagaaagaaagaaagagttctcagtcagcgctcagtagaaccatgtggagagaggctgtctgtcacgaggtcaggctgagctgagccctcagagagaatgtgtgtatgtgtgtgtgtgtgtgtgtgtgtgtgtgtgtgtgtgtgtgtgatgctggtggtggtggtggtgttctttgaggctggatgtgacaataattgggagaggcaggagaggagtccaggaagcctgtgttactcctccactacttcccaagacctcatttgaacatcctatatggaaaggggcattgagccctcaggtttcccagaggaacttccaataaagaccagtctcagggacccgcaaccattttaatggtctgcttcctgacaaggcactgctacaggcaaggggttttcatttgtaaagggttggtatcacagaccttactaggaccaagattttagcccatagctgggtactggggacccagaacaagcaggtgtgtgtgtgtgtgtgtgtgtgtgtgtgtgtgtgtgtgtgtgtgtgttgaggaagcctgagaagccctaggtctccaaagagcagaggagaagcaacgtgctttcacgcaggcactgtctcatgagtccaagtaggcgtgcccaaccagcatggtatttcataaagcagcaagctctgagaacacactcggctgccaggagacaaaacagggcaggccgcatctcatggttataaatggaccctagagtcacacacggcctggtccagcagtgagagcccatcctgacccatgttgcctgccataatgctcctgcagggcagcagatggttggggtgaacctagaaataatacccatatattt

SEQ ID NO: 95 - DNA, 710 bp, Mus musculus
  modified_base (686)..(686): a, c, g, t, unknown or other
ttttttttttttttttttaacacttatacattttatttagttaaatcagccattgtacaacattgcagctatgtattgttagtgttgtattgttttccaataactaatacatgccctcatagatatattcaattagtgttatcaccatgggaacaagatgctgattcatcaactgaaaattcacttctcacagtattcaagtttttgataacacagcaaaaaaaaaaaaaaaattaaaattgaaggaaaaaaaagtgaagaaccattaagttgccacaaggacatcatctgcactgcaaataacacaacagaaaggcttttcatgagctccagggcaaagatctgataagatggccacctcatatctcaagaagggctgccacctgcctctctctctcagtttggatgccaaagaacactttgtttctacacagtcccccagaaagtgctagtgccggggactcaggagatttgcctgatgggaaacctctctcccaggaaaattcttctcttggcaatgttactcaaaaagatgaagtgctattgtttgtcgtgtttgtgtctgacattccgagcaatgagtcagttctgcacacaggaaaaggctagataggactggaaaaatgtcagtctctggagggtaggctgttttccttctttctctctctctctttctttctttctcnctttctttctttttctttttaatt

SEQ ID NO: 96 - DNA, 695 bp, Mus musculus
aataaagtctttcctggagttaggaacgacagctcaagttcccgagctttgtgtttgcaatgtgaaggtaacaaactgtctggaaagacacccgacatcactcctagtgctcaggtaaaggctggggtggcaggggtcacctgtctcaaccgttgtttaggaagtcaaagaggcggttctagagaagggtgtttgagtgggtgtctggttggggcaatttgcatcttgctgtcgtcatgtttggctgaatcccttcttctgcctccaaaacaaagtacgtgtgacaaatgtcataagcaaatggcaggcacatgaactggcattggcgtgtttaagtttaggatgccttagagggtatgtggttccaggaagggaagtctccacaccaggcaacactgctgttttcctgaccgttctggatgaacatggccttaaccaaaacctgtgttctgacttttccctccccgttgaacactcttcatcttgggcctctccttggtgcattcccggctcagggaaccataccatccagccctggtttgaacactgtgcgttagtatacagaatgcaacatatagatttgacaagggcttgtcacaaagggaaccaagtaattgtaaaacagaaatcataacatttgaaagctggcattctcttggagatttaaggattgtgtcaataaatatttattagcc

SEQ ID NO: 97 - DNA, 3222 bp, Mus musculus
caagccaggaagcagcattgttccatggcctccgcatcagctcctgcctccaggtacctgtcctgtttgagttcctgtcctgtcctttgatgatgaacagtgatgtggaagcataagccaaataaactcgttcctcccaagttgcttttggttaaggtgtttcatctcagcaatggtaaccctaactaagacaattcttgtgtttcagggtcttgctcatctttgcaagttctggactcagaatttgttacaagacactaacttttatcgtggttccattctggacctggcctcagcagcccttggggggaaaaaattgttgtgactgtcacatgagacttcaaacagttggctcaattctggaaaaataaagggtactgtcaggtaggtcctcctgtctgtagcagtgttggcctcgagagagaagatggcaaattcttcactttcccaagtccttctaatgtggaagccaggcaagatccagaagggaccctgcagtgctgagcagcggacactcacctcaagactcttgcgtgacactgaaacctgtcgacggaattttagaaatttcccatacccggatgtggcaggccctcggaaagcgttgtgtcagctccgagagctctgcctgaagtggctgagacctgaggttcattccaaggaacaaattctggagttgctggtgctggagcaatttctgagcatcttgcctggggaggttaggacttgggtaaattctcagtacccagagagcagcgaagaagtggtggctttggtggaggatttgactcagatcctagaagaagaagaagctcctcagagttctgccctcccccaagacaccccagaggatgaccccaaccatgaccccaaccctgcttcccaggcagggtggctcagtgacgtggtgaccaaagacttggtgacattcaatgacgtggctgtggacatcacccaagaagactgggaactgatgccccctgttcagaaggaattgtataagactgtgactttacagaactattggaacatggtttctctaggactgactgtgtacaggccaactgtgattcccgtcttagaagagccgtggatggtgataaaagaaattgtagaaggccctaatccaggatgggaacctaaagctcaggcacagtgcccagcaaagcacctccctgaactcaagcaggacggaacccaaaccgtaaaactggaagattcctatgacgacgacaacgatgacagcgtagagagtccgccagtgtgtgccttcgggatgatccacatagatgaggaaggcttcagtgtgaagtcagagctttcacaagaagaccctacagaagaataccttagcaaatgtgacatatatagagtgacttttgaaaagcacacaaacctaggggtccagtttgatacccagtcggatgataaaactgctctgcataatgaaagcaagccaccgtttagcaatgcctcgtctggtggtgccgtgcgtgggaaaatacttcctggagataagccttattcctgtaatgtctgtgggaaacagtttagaaagtacccttccctcctggcgcaccgagagaaccacgccaaagagaaagcttatgagtgtgaagaatgcggcaaagaatttaagcatctctcctccctcatcgcacatcagagaatgcacaccggagaaaaaccgtacgaatgccaccagtgtgggaaagccttcagtcagcgagcacacctgactatacaccagagaattcacactggagagaaaccctacaaatgtgaggactgtgggaaagacttcagtcagcgcgcgcacctcaccatccatcaaaggacacacactggggagaagccgtataaatgtctggagtgcagtaaaacctttagccatagttcatcactgattaatcatcagagagttcatactggagaaaaaccttatatatgcaacgaatgtgggaagactttcagtcagagcacgcaccttctccagcatcagaaaatccacactgggaaaaagccgtacaagtgcaacgagtgttggaaagtgttcagccagagcacttacctcatccgacaccagagaatccattctggagagaagtgctacaaatgcactgcctgtgggaaggcctttgcccactcctcaactctcattcaacatcagaccacccacaccggagagaagtcctatatatgcaacgtgtgtgggaaagccttcagccaaagcgccaaccttacccagcatcatagaacacacactggagagaaaccgtacaaatgtagtgtgtgtggaaaagccttcagccagagtgtgcacctcacccagcaccagaggattcacaatggagaaaagccctttaagtgtaatacctgtgggaaagcttacagacagggtgcaaacctgactcagcaccaacgggtccacactggagagaggccctacaaatgtcaccactgcgggaaagcctttatctactcttcatcccttaaccaacatcgaagaactcacactggagagcgaccctataagtgtagtcactgtaacaaagattttagccagagaacatgccttattcaacaccagaggattcacacaggagaaaagccctacggatgccgtatatgtgagaaagccttcacccagagtaccaatcttattcagcatcagcgggttcatacgggtgccagacatcgcaattgacagatatgagagactttgtttatgctttaaaacttgattgcttaaatttcattgtgtgctctgtcaaaatacccaaaagaaacctaaagacgtgcaatatgcttgataccacagtgtcagaaagtcccagaagtggtaggtaaaatggctctcatccatttagatttagtgtgagattcaaagctccatcaactagctagcttttatctggtatcacttgaattcattccagaaagaaatactaggaaaggacaattcataacctgtgattcttcaactcttcgtatatttcaagtatgttttattgaggccttaggagtatgccttgggaaaacacctgtcaagggggtctcacacaagagagtaatcctgacattataggaaagagggtagatgcttcggggcctttgcttcatcctatctttgaagccttaaagtaagtaaaaggtcccaatttttgctccctcttttcccattgcaacttccatgtgaagccagtaagtaaagctcgagcc

SEQ ID NO: 98 - DNA, 2153 bp, Mus musculus
gctctctcccagggacacggggctgattgtcagcaggggcgaggggtctgcccccccttgggggggcaggacggggcctcaggcctgggtgctgtccggcacctggaagatgcctgtgtcctggttcctgctgtccttggcactgggccgaaaccctgtggtcgtctctctggagagactgatggagcctcaggacactgcacgctgctctctaggcctctcctgccacctctgggatggtgacgtgctctgcctgcctggaagcctccagtctgccccaggccctgtgctagtgcctacccgcctgcagacggagctggtgctgaggtgtccacagaagacagattgcgccctccgtgtccgtgtggtggtccacttggccgtgcatgggcactgggcagagcctgaagaagctggaaagtctgattcagaactccaggagtctaggaacgcctctctccaggcccaggtggtgctctccttccaggcctaccccatcgcccgctgtgccctgctggaggtccaggtgcccgctgacctggtgcagcctggtcagtccgtgggttctgcggtatttgactgtttcgaggctagtcttggggctgaggtacagatctggtcctacacgaagcccaggtaccagaaagagctcaacctcacacagcagctgcctgatggtgacaatgtccttctgacactggatgtctctgaggagcaggactttagcttcttactgtacctgcgtccagtcccggatgctctcaaatccttgtggtacaaaaacctgactggacctcagaacattactttaaaccacacagacctggttccctgcctctgcattcaggtgtggtcgctagagccagactctgagagggtcgaattctgccccttccgggaagatcccggtgcacacaggaacctctggcacatagccaggctgcgggtactgtccccaggggtatggcagctagatgcgccttgctgtctgccgggcaaggtaacactgtgctggcaggcaccagaccagagtccctgccagccacttgtgccaccagtgccccagaagaacgccactgtgaatgagccacaagatttccagttggtggcaggccaccccaacctctgtgtccaggtgagcacctgggagaaggttcagctgcaagcgtgctcgtgggctgactccttggggcccttcaaggatgatatgctgttagtggagatgaaaaccggcctcaacaacacatcagtctgtgccttggaacccagtggctgtacaccactgcccagcatggcctccacgagagctgctcgcctgggagaggagttgctgcaagacttccgatcacaccagtgtatgcagctgtggaacgatgacaacatgggatcgctatgggcctgccccatggacaagtacatccacaggcgctgggtcctagtatggctggcctgcctactcttggctgcggcgcttttcttcttcctccttctaaaaaaggaccgcaggaaagcggcccgtggctcccgcacggccttgctcctccactccgccgacggagcgggctacgagcgtctggtgggagcactggcgtccgcgttgagccagatgccactgcgcgtggccgtggacctgtggagccgccgcgagctgagcgcgcacggagccctagcctggttccaccaccagcgacgccgtatcctgcaggagggtggcgtggtaatccttctcttctcgcccgcggccgtggcgcagtgtcagcagtggctgcagctccagacagtggagcccgggccgcatgacgccctcgccgcctggctcagctgcgtgctacccgatttcctgcaaggccgggcgaccggccgctacgtcggggtctacttcgacgggctgctgcacccagactctgtgccctccccgttccgcgtcgccccgctcttctccctgcccacgcagctgccggctttcctggatgcactgcagggaggctgctccacttccgcggggcgacccgcggaccgggtggaacgagtgacccaggcgctgcggtccgccctggacagctgtacttctagctcggaagccccaggctgctgcgaggaatgggacctgggaccctgcactacactagaataaaagccgatacagtattcct

SEQ ID NO: 99 - DNA, 745 bp, Mus musculus
cccacgcgtccgcccacgcgtccgcccacgctgtcgggggagcacatagatgggtgctagactggtacaatccttcctcagaatggctgcctttcagaccagagaggagaagggtaagaaagctcttacagccttccagctctccaggagataaagccttctaagagtcaccatgggatttggatcaagaacttccattacttacaaagaagtgacacattctgcctcagtttcccctcaagcttttgctcatgggtccggggacaccaagcttgctcttgtgcatgtttccaaggactttctgtctctgtcacagatgcatggctccagctctgctctgtgagatagagcggtcccttctcccatcctgtgtaaccatctacatatgtcctcatgtcaagggcaccctggctctccttcctggcggtgaatgtctatcacttttctatggcccctgtcttcttcctctgcctcacgccctgactgagaaattaggatgccatgtctccccaaacgaaggtcaccatgtagtcttacatgccttgtggtctaggagggcaggaggcagatgccatagtggtacggagctggggtgtcctaaacctaacagaagcgcagcagaggggatatgtgggcccagctgtcctgggtgggctctgaatcttcataggtttacacaccacacactgagctcggaaaaggtcaacgttaataacatcgtgtgaaacccctggaaaaaaacaaa

SEQ ID NO: 100 - DNA, 712 bp, Mus musculus
  modified_base (25)..(25): a, c, g, t, unknown or other
  modified_base (78)..(78): a, c, g, t, unknown or other
tgttcgaagttcccttcgcctctgnggggtttcccttttcaggtctttcggttttttggcgaaagaagagcagcccanagccgtggggtgaccccggccctggctcctcccccccccagagttgcccccctcatttgactccaagttatcctgtcccccagatgcagcatgccaggggccagaaactggcctctggccttcctggccacatgcccagcctacctccataccagcctgcgtccggcctgtgctatgtgcagaaccactttggtcctaaccccaatgcctccagtgtgtacccagcttctgcagggacctcccagggggtacagcctccctcccctatcagctgtcctggcactgtgtattcaggggccctgggtaccccaggggctacaggctccaaggagtcttccaaggtagccatgccctaaccagtctgcagaggcggcttccaccttgttggacagaggaaggttctgagaatgtaggaattatttattgaagccagggcatgccggcctgtcattccagctgcttgggggttaaggccaataggtaaaaggtcaaggtctgtctgggctccagagtacgtccaaggcaagcctaggatatgtattaacaaaaccctgtctcagaatgaataacaatgactggggctctgtggtagaatgcttacttagcataattaaggccctgagtcctcagctcc

SEQ ID NO: 101 - DNA, 366 bp, Mus musculus
gaccctcctctctaacttttatgactttcaccccctttgagacatattctattgcatttacgataacaggtttcatccaggtgtccccgccacatcgtattaatgagagagagacgcgtaagaacttttatttattatagaaaggatttggggaatgtgggtctaaggcccgggggtgtgggtaagtggtgtgcatgtggtcctggggctaactcccctaccaccaaaagaactatgtgggtcagcttgaagcttgattcccttcctcctgaagccaggagggaggctgggtgttaatatgaatgacggtttctttttttaagtgaaccattcatgagcaattaaaaaattccttcatacattgct

SEQ ID NO: 102 - DNA, 336 bp, Mus musculus
  modified_base (103)..(103): a, c, g, t, unknown or other
acccagtgctgtatctccttttaatacctacccttacaacaggaaatccgtgcactctgtttccagtgtaccttctaaaagctgatattcaaagagaatgctngtaatcgcctttagtcagccttgaacgggcaagtgacactgtggacctcggtcacctccctccctgaagccagtgcgcctgtgcatttgcaaaatttgttttaagttctggcaccgtcatgtgctgacaccactgcatgtcagaaaatccaaatacagcagcctgaggagacgctgtcaggctctgtttgggcattgtgcttatttgaataaaggtgtaaaggaccaaccact

SEQ ID NO: 103 - DNA, 318 bp, Mus musculus
ctcctcactttagcatgttcgcacctctgtaggactctaacagcagctgtaccatccagtaatcgcccgccctcctgcttgttttaaccgggcccagtgagctcagatctgcaccgttcccgtctgtcagtgagtgtgtgtgtgtgtgtgagagacccctgggtgggcccttccctgggagagggtggagagttctgcttttctctccacacatctgagataaacagctgggtgtaggcagggctgttccctagagcggtggtctcagaggagttgtattgtttccataaattaacaaagatacgtgtgtgttctacc

SEQ ID NO: 104 - DNA, 403 bp, Mus musculus
tttttttttttttttttcgagaaagagccaaagacaaacgctttattatgaggcctgttcaagtaaggtttcagtgtgcaccagtgagcgaatgcagatctgcatcgaatgctagggatgaacaccaggttaaaaaggggctacacagttctgttttgttgcttcccccccccccgctaacaccgcccttccctaaggcaagaaaacacaccatttagaacagaatgttacagaagaaagctacatcacagtacagtacagaagataagagcatctttgtgtggaggccactgtggaccaggacatcccctccaccggcagctttccagtgcggtttccaatgtcaagcactgaccacagcgttactttcctttcaatgacaagctctgagtacattttctat

SEQ ID NO: 105 - DNA, 716 bp, Mus musculus
gctgggtggtggcccctggaggaacccaagggggggggcccccccccggccttcaggcttggaaggccaagaattcggaggggccctttcttttcgcaccactttcggcaaggggattgttcctttccaggggccccctaggtccagggggttcttccaccctggtaaaggggggccaaaacccaacccaagggcccagggccctaatggcaactgggccaacaggatttcaccacctggccactgggagcagcagcacccctgccatcagccagagcacacttccaccttgggacaggcagtttaccaacaatgggctggtgggctccagcagaagcctgcagtgctgagatctgcagggggagcaggcagccctgccccagactgagcagaggctgtacccaagaacaaggctgtcgggacctccgatctggttcctcagtcctacgaggaacacttcccatgtaggcccgtgttgaggacaggaaacagagatggaggtggcaaagtggcactgtccaaggacattgtcacatcattctgatcaactggccaggaggaggacagggtcctgcacccagttgggtctgggtaccttggggaacactggacttccaaaggccagagcacaggacccagtccaaaccttggatacctctagtctgccaactgttcactgtttttcaaaataaagagctgggcctacagcctcaggg

SEQ ID NO: 106 - DNA, 1542 bp, Mus musculus
ccacgcgtccgtacgttgcatctttaaacgcggaggaaaatgccggatccagcgaagtctgctcctgccccaaagaagggctctaagaaagctgtcacgaaagtgcagaagaaagatggcaagaagcgcaagcgcagccgcaaggagagctattctgtctacgtgtacaaggtcctgaagcaagtgcaccccgacacgggcatctcatctaaggctatgggaatcatgaattccttcgtgaacgatatcttcgagcgcatcgcaggaatgaagactccccacgaccacagcactcctatcccaaaaggcatgtggacacacgctcctcgtcaccagctgcatcagaccccttcgggatgcctcgttctcagctctggaaactctgcactaaggatatactgagctacctgcctgcccgctcgctggctcggctgacccaccctaactagctccgacaatgcgggaacctgcgcggaggccgtgtgtgctggacagaggccgtgtgtgctggacacaaaggaggcagaggtagcagtctcctcctgcttgctctttggcgtctacccaccagagcctcgggttaggcgggactttgaatcttctccccggcagcagcggcagcagctgcgagccccaaaggcgaccaccaggagtcgctatgtgggtcctcgaccgcgctgatcagactggcgggctggggtgagtagttctgcagctgcgcattcgcggagactgccagcctctcgtgatgctgcgctcgcgcagatgcaaagtgaaccatcattaccaagagctgagtctgctttggaatggggcccttccctataccggagggaatcggacacgcaccacccttttccacacgctgccgcagactcagtagagatcattcactcttgtctgctaggtgaaagcaattaatcgtaaggtttgagggagattgaaaaagtacgccgaggagcgtttcgggtcacgggggtctccgagctttggcaacgatgacccagccgcacactgcctgcattgtatacagatgaccacgagatggcgccagcgagtcacttcgccccaaagtcctattttctcttcttttactatgtatctaggtagggggccttgattggagtttgttttctctgccagttaaagaataaacggcagggggaaaaatgttgtggagcaggtagcaaagggataaatctcagacacagcagacagaatcaacccgtgaagaaagattatcaggctgagaaaacacacgcacacagagtacggcacacagaaagattgggcgtgatctcaggaagttggccttttctggaggggtggggggcttgaggatcttttaggggatcttctcctagtctacgagttgtcagtttgaataaagacagagaaactgataggcccacatttctggataaacatgtactagcctggccctgaacttggactgcgctgcctgcccatgctggcaagagaaaaagtccacccggtttttgcctcaggtcaggagcattaaaaaaaaaaaaaaaaaaaaaa

SEQ ID NO: 107 - DNA, 1809 bp, Mus musculus
ccacgcgtccgcaagcagcggaatgggaagccttagaaagagagtaacgttttagggaaaataatttttcacctgaaattttcttgtctctagaggattcatttgcttaaagtgatctccgcatgtagcctacaggaagcatcatggtgaagaaggaaaaaacgccctccccttacaccaaaccccttgatggaggatgggggtggatggtcgtgcttcattttttcctggtaaatgtgtttgtgatgggaatgaccaagacatttgcaattttctttgtggtttttcaagaagagtttgaaggcacttcagagcaaattggttggattggatccattatgtcatcactccgtttctctgcaggtcccctggctgctatcatctgtgacgtacttggagagaaagctacctccattcttgggacgttccttgtctctggtggctatgtcatcagcagctgggccacaggcattccctttctttgtgtgaccatggggctgctacctggtttgggatctgctttcttgtaccaagtagctgctgtggtaattaccaaatatttcaaaaaacgattgggcctttctacagcaattgcccgttctggaatggggctgacatttttgttggcaccctttacaaaattcctcatagatctttatgactggacaggcgctcttattttatttggagcaattatattgaacttggtgccttccagcatgctcttaagacccatccacagccaatcaaacaacaattctgacattgaaaacaaaggtagcattttgtctgcaactgaaccagaggcatcatacaagacagagacatcgaagtgcaaggagacacaggagcctttcatcaaagacagtactatgaagaaatctgaacaacctaccacaaccttaactgtcttaggaaatcaaagcgaagagttcagcaataggcctcacaggaacaggccgttacttatgagcaatggcaaaagtcacaagaaaaagtttgtttcatggaactgcaaacaaaaacttttagatatctcgctctttagaaaccctttcttctacatttttacctggtcttttctcctgagccaattagcatatttcattcccactttccacctagtagccagagcaaaaacacttgggattgacgtaatggatgcctcctaccttgtgtctgtagctggtatcactgagacagtcagtcagctcatttctggatggattgctgatcaaaattggatcaagaagtatcaataccacaagtcttacctcattctgtgtggtgtgactaacctgcttgctcctttagccaccacattcccactccttatggcctataccatcctttttgccatttttgctggtggctacctggcactaatactgccagtattggttgacctatctaagaattctagagtacacaagtttttgggatatgccagtttctttgccgggatagctgtactttctggaccaccaatagcagatgtaactcatgggtggaccacttacctaatgcacatgaagcccttgaaaacctaaactaaaaacagttccagtgaggagactagaaggaatggaagacaagcgagatggcagagcaaagttctctgtctggacaaataaaagggaatacactaacgctggagaatttgtaaactgttcattatcaggtggttaatttccctccaaccacaccacccagccagcttcactctgactcagcattcctaagattgatgaatatctatgaaaacatcaaaaataaatttcaaatggctctaaaaaaaaaaaaaaaaaa

SEQ ID NO: 108 - DNA, 1555 bp, Mus musculus
agtacacaccaggattctgcgtgtcattgtcctctgtccgccaaaaatcatttttgacacatgacacaagctttctctaaaacaccttggggggaagtatacttcagatatggcttctggggtaaaataaatcctaggccagagaaaccagcttcctctcaagaccccttacctgttagaaaccagagacacagcaagaattttttttacaccaaaggatgccattgtctatgaacatgtggttgtcagtgctctgattaccttctaattgctttcagcaaaacacagagcagtcatatacaacaaagtgaccagcatggtcccctcaaagctccctagcatgtttgttactataaagtgtgtgagtgtgagaatggactttgccaaatacatttttctgcttttgaattggccaaaaggtttcagcatatttattctacaagcattgcgcacacacctctgaaatatatgccaataattgatgtcctttacctcagggagagttagttcaagtctacacaagggaaattagtggcccccctaagtagatccaaacaattgtgccccatcatggataggactggctggaatgctttggagagaaagtcagagcaaaaaagagaactggagcctcttctccatggactgcaaatggtcaaagaatggtaggcaactatgctttcttttcccatggccctgatgggcccctatcttccctacacagctgtgtcttcatttataaaatgggggtgacgctttcatagtggctttaccccttcctacctcacagatgtgttgtgagattaatgaaattgtgtatacagtgttttcagtttctggagaaaaactatttatggacatttcgagtattatatagatatataagtgatctcagtttctcactcactgttatactggtgtgctgtttttacttactctgtaaaactacagttaatgtcacggccacctcagatggctatcagagctctgaaacttccctcccgcacacctgactgatgttgagttagctgttttggggaccacagaggatgtctccctccagctgaaaaggtggtccaggacacaggtctcacaaacctgcatcaggatccaggttagcatgccacacctggatgcctcagcacttccagaagaaggcctctgactttcacaccccgaggtctcggaggagtagattatgatctgatgtcatctgcccttcgtcttgcttgcaagggtgcatggttcgatcctatgcatcttgaaaatgaattttgtgattggtccagatgctaatttgcacgtcgattcaccttcattgcctttaaccttcttttgagggcaaatggatgtaccatttcaactttgatctcagaagcgttagtttgtattgactcattgtcacgttgctctcttggagtaaagttagctgacatcgtttaaagatgggaaggtgtgcaacttctttgatatttgatgacatcatatctacatttgttgtaagacatattgcataccaattataactatgccaattaaagtggttaaaagcttg

SEQ ID NO: 109 - DNA, 594 bp, Mus musculus
aatatccttgaaagcattctcacccacccttgggcactggcgtggtttatccaagaagggcactttggaaagagcttatgtctgtatgatttgagggtccttcccactcagacactgggacctggtaaaatagaagaggccacgggaggcagaggcaggcggatttctgagttcgaggccagcctggtctacagagtgagttctagacagccagggctatacagagaaaccctgtctcgaaaaaaacgaaaacaaacaaacaaacaaacaaaaaatagaagagccagcagggaaccctcagagcctccagcctaggtcatcgtgtggacatctgcaaaggccaggcctgctgagcaagggcggagccagtgcaggccagaggagcttcaagtctccacagctaagtgtctgtctgtctccttattaataaattgtcccttgtctgaggtttgtgtgtggttatgtgtatgtgtgtgcatgggtaagtacaaaggccagcaaggattgaagcaagtacagagactctgtaaagccctcagccatgagatttaaatgggtcccgagccttatgtccattaataaagacattgtcat

SEQ ID NO: 110 - DNA, 734 bp, Mus musculus
ggcatgaaactgttgtctttattcaatgaggctgagaacagggaagttcaaaaggcacacagttggggggatcctctatcaggggtagtataagttaagaaagttgtccaaggtggaaaaatagcaggaaggtctcaacgcctcctgcccacgggggcgtcttcagaactgtcatctctatggtgagtggctcggagagaggacgatgaatgtcacagatgaatctcttcctgggggctgtttataaggctctcccgtacccagatgcgctcgtgaacaccgtgcgcatgcgcgcacgcacacacggcttctaggagtagaacctgctgttgcttactctcttctctctcagcctccggttgcacttctcctggtacagctgcagctgattctcgttaacattgaactccttcaccagggcatcacggttggctccgcgcaggttctggtgcgtgtcgtaaaggaagagctggttgttgagctcttcttgccgcctccgcagttggcgacaggaggaatagagttcctcttcactctccaggactggcctcatcacacaaaaaaccaggagggatgccagctcgatgtcttcactgtacccattcttcagagggactgatctaaacccggatttgatgcctttaatggggtacgtggcattagccatgaagttgggatcactgaacatgtcttcttcgtagaccacaaagcgtatgaaggcaaggtttggatca

SEQ ID NO: 111 - DNA, 683 bp, Mus musculus
  modified_base (20)..(20): a, c, g, t, unknown or other
cgtcggttcgttggttgtcntgttcctctgagtaactgtgtagccaatgataaagtaaatgtctttcttgcttttatacagtatctataatggggacataaagagctccagagcccagcagaatagctactccggtacctcagtccactgggatttgggactggtttaaatttcccagtcaagttcaaggaaatgaaactgttcctgtgacctagtagtaaattagcactcatcactcactcctgaatatttccgtaaagtcttgaacattgaagtatcatatagctataagatataaccttgtttgtgtggtattattttggtttttgacacaaggtttttctgtgttatcctggctgtcctggaactaagtctatagaccaggctggcctcaaactccgcctgccgcctctgcctctggaatgttgggattaaaggcctgagctgccaccaccacctagtcaatttccatattctttaaagctggaaatcctgtttatctcagatcattaactttaaaacctcagtagtggcagaaagatgcctcaaccagtacaggtatttgctgccaagcccgcccaatgactgaagacaacctgctctcatgacttgttctttgaccgtcatacatgggacatgccacccatatccccacacttacacacaaaattaaacttcatttt

SEQ ID NO: 112 - DNA, 405 bp, Mus musculus
tgtataaacatctatctgtacatatacatgtgtacccaaaagcagattcgcatccatttttaaattggcttgtctttattggaatgcaagactaaatataggcccttttataagatacattacttgcaaacattttccccattctttaggtagtttctcattctctccatggtgctttttgaatcacaaaacttaaaattggtgaagtccatttttcacttgtactgtttctttttttgtttaagaaaccattgctttatgctgggcagtggtggcgcgtgccgttaatcccagcacttgggaggcagaggcagaggcaggtgaatctctgagttcgaggccagcctggtctacagagtgagttccaggacagccatggctgtatagagaaacccctgtcttgaa

SEQ ID NO: 113 - DNA, 485 bp, Mus musculus
tttttttttttttttttcaactaaatcaaatttttatttttcttactcaaagtaacacagtttaatattttttagaaagccaaccacagtgacttacgccagcagaaaatatctaatctttatgacctggcctaaacccaagagccagctaaaatcgccttgcttttgtctaacacatagctccaaagaaatggagaccatgaagcaatggctatgcgtagtaggtagttctcactgccctgtggactcttatcaccaccatagacacaaaagatctccaaattttttgtgaaatttacacaccctggcttctttcctccactcaaaacaccttacagaaaaggctgtcacgccctatggccccattcaacacctgaacactagttagggtgacccacatggataaccccttccaagtctgtgtgggtgtgtgtggggggttgtgtgtgtgtgggtgtatacccacccttactgcccagtctctg

SEQ ID NO: 114 - DNA, 1901 bp, Mus musculus
ctgttcattaagtgaagaaatgagattagggacccctgaggaaaaaggaagggaaacagcagggcacttgaaagaatggggaatctaattagacacatgcatccctggccaaccactcgtcctctccctggccaatagatgagggggtgtctagctgtcccctgctctgacaggcagtcatcatctccaccagaagctccctggaagctgctgagccagacggaaccaaaagcatctaaaaggatgtacctcagagggattcagccattcccactcctacccctccctcagaacctcatgaagttcctggctttcctgagtctgttgagcttggtgctgcagaaggcagagacagcttctctcctaggggagagagaaagagaagagcagagccctgaggaaggtgacacttacgcgtccctgtatgtggggaaccataccctgagcatagaggactacaacgaggtcattgatctcagcaactatgaagaactggcagactatggagaccagatccctgaggctaaaataagcaatctgactcttccaacaagaactagtcccactagcactgtggctcagaagacattgtcaccaaacctcacgatggccgtacctaccaccactggcctactaaactcccagagcagtcatggcctgcctacctgcctggtctgtgtgtgccttggctcttctgtctactgtgatgatgcagacctggagaacatccctcctcttccccagatgaccacctacctatatgctcgcttcaaccacatcagccacatccaggctggatacttcaaagggctgacaaaactgagaaggatcgacctctctggcaactccatctcctccatccacaacgatgccctccgcctgctgcctgccctgcaggatctgatccttccagagaaccagctggcagccctgcctgtgctgcccagtggcattgagttcctggacgtccgcctgaatcggctgcagagctctgggatacagcctgaggcattcgtggcgctgaagaagctgcagtttctctacctggccaacaacatgctggattccatccctgggcctttgcccctcagcctgcgctctctgcacctgcagaataacatgatcgagaccatggaaagcgacaccttctgtgacaccggggaacacagacatgagcgccggcagctggaagacatccgcctggacgggaaccccatcaacctgagccttttcccagaggcctatttttgcctgccacggctccctgtgggccacttcacctagggccactgctcttctcttcccagatggtgctaagaggctcactgagggagcactatttacctgcacccagaaagtcatctgtagcccaagttccaggcagcctgtgagccacagctgcaaaattgcacaacacgcacgcacacacacacagagacagagagagagagagacagacagacagacagacacagacagaccgacagacagacagacagggccttcagccacttaatttgcatttcgccctcctctttccctacaccttatggttcctgactcagagaacagcagcatccacagcagagatcttttccacactctccacacccatcttcccacacagaattccaggagaaccatgaaagaaagggatggaagaggaggcagcggagggacagaagctaggagggagggggacgagggagaggaggagggaggggaggagggagggaaggagggagggggaggagaatcatcagtgtgctgaagcctggtctttctgactggtaggctgacaggactgataattacattttccagaattttgcagttcagttgttaaacacagccattatgaaaaattaaattatataaccttgcaaaaaaaaaaaaaaaaa

SEQ ID NO: 115 - DNA, 474 bp, Mus musculus
tttttttttttttttttcgtttttctcgttatctgtacttggctgtgggtcataggattgcgactaaactcaggtctccaagctgggtggcaaacgcctttacccactgagccatcttgtccacccaggattatagcattctttagcaagacaaacaaatcaaactaggctggccttcccaaaaagaccccaggaaaacagagatctgaaacgcaagaggtctcagacagatgtgtgcaagggctgagagtgttgaatgatacagcctttgaaagacagagggcgtttctcctgggttcacaggacactatgtcctggctgtccactgatgtcacactttacaaggaagacctccaccaggctccccagggccctctgcctgttgaagtttatgcttgggagtatgacccatttccagagacttcaggatgggggtggggccctccaggatcccacgggcaccaaatccagact

SEQ ID NO: 116 - DNA, 540 bp, Mus musculus
ctggagagccccttttgaacttaaagggcagtggcacttccggaaatcccagaggactccataagtgctggagaaggctctctgctgctgctggtggaaagtcctagaaccagggccatcctcgtgatttaggatggagagtatcctctcacagactgtcacagcatccgctcgtgatcctgtgtgttcccttctccttggctgccgggcacggatggtgctggaagaagggagggggacgcacagagctgaccctcctgtactgtctgttgagtccacagtggatgttttcatgaggaaaagcacctgtttccagagccatcagagctagcatcagccttcaagattctgtccttgaaccaggaatggaccctccagatgccagtacaaaggcacacagcagctgcaaaacagactcctgagccagaagacgctggctcttagtgccatccacaagtgagctatggtatctgtgacttagaagttggcaccttgatgatggccttataaaatacaatactaaagtgtaatatatgatgg

SEQ ID NO: 117 - DNA, 387 bp, Mus musculus
tttttttcaagggaaaaagagatagtttattctgggcccaaatatgaatagttgatgtctattaatggactcaggttatctcaaacaccatgatccaatgcggtaacagtttcatgaaaatgacacaccaaggcaccttccatccaaatacactggtgggggcatcaggtcgattgactccagtgaagaagggaaatctctgttttaggccacagacgttatctgatgacactcttagcctttgaaccggtgggatgcagaggtatgtttgtccattccagaaggacttaacattagtcacgaggccatcgggtcacatcagaggttggagataaacacccagcgtaactcaggaagctagtgatatagtccaggtaggaagtgggt

SEQ ID NO: 118 - DNA, 645 bp, Mus musculus
  modified_base (54)..(55): a, c, g, t, unknown or other
  modified_base (57)..(57): a, c, g, t, unknown or other
  modified_base (69)..(69): a, c, g, t, unknown or other
tggagcccctttttaaaccaaaaaaagaatgtagatgcccttcttgtgattcanntnccccagcccatnacccagcccaagaaccagcttaaagatgcccccctaatttcttggaaagaagaatctactgaggaaaaaggcagttgtcatacttgctaaagagttcatgtttaacatttcactgaaatcactccaagcctgcactaaataccaatcgagtgttattctgcctatttctgtgttgtgctctttgagcaacaaactacggggaaattctgtgaaaacaaaaaattcttttcctttttttaaaaaatgaatgactgctgtattaaatatacgaatatacaagctttttttttaatttaaatacacttctggcaaggttatagatgattaacctctgttcatagacttatatatggaagtagagttttttgtttactttgaaactgtttcaagtgcaattgtttcttataaaacatggtcgattaccactaaattctcattttagctggttatctgcaaatatatagtatgtatcccctgtctcttcttgtgatatttagtttgcttattttaaagcagcaacattagctacgagtgtcttgcaatatttttaccaacaataaaattaagtagatactt

SEQ ID NO: 119 - DNA, 570 bp, Mus musculus
agtatttgaaaactttattttctcaaatgagcaccaacacagatcagcaatgacagaaataacgcacttcttactaatactgaatcattatgtacaaataccggaaggaggtgaagacaaattattcaaaaacaattgcctttgttactgaagcaaagtgacctggggaaaaaattcccacccaagaaaggaacaaaaaaagaagaaaaaagtaacaacaaaagcaattccaaacccaacaaatacagtttgtaaacacagacagacagacagacagacaaatccatggtacacagtctttgcaggctgggaaaaggaagttgactcctgttctcaccaaaccactgtaagacgctggacagatctaactccaggaggacaacgcctttcgggtacatttcatgactgtatagtaattttattaatcaaccacaatttcaaagacaatctttcccagtcataggactagtatttccattgaggcagattttttaatataaaagtgtgttcaagatttgatttgccagcctctgcctgaaccccaagcaatctgactttaaaaaggaaaaa

SEQ ID NO: 120 - DNA, 792 bp, Mus musculus
gggcggaggaaggccgagtggccagcgggggcgcccccgggcgtggagacctcagaatccctaagtgactccctctatgactcgctatcctcctgtgggagtcagggttgagggaccgcacccactacagttcctctggagctagggaccctcaacgacctgcttccgcgctccacgccccacgcctttgggccggtgaagcttgacctgaagggaccaaggagaaagaggataagaaggcgatggggggtccctggcgtatgccactgctgctgtggatgcgacaaccatgctcagctcagggagagacctcatccccagtcccttgactcccccagagtaaggctctgctctacgggaccgggggctccaggctgctttgtcccagctcccacttcaggccgagccatcttgcggtgctaggcttcctgcccgccagctgtgccacctctgcccaacctggctgcaaccctgccccaaagcccccatggggctgattttggaagccccaggcttatggagctagggggtgagggggacaagtcgccttcactctgccctggtcctccctgctgtctgaatggtgctgcctcccttccccacatcgtggggtctgttggtctgtcttcatcttggttttatatatatatatatatataagcgcctggccagtccccagccctagccgcactgcggttaatatatcgtgtcgtgaaaagcagccctgggttctgcagcatccctaatacacccgtggaggcctctccccaacgtgaacaaaaacaaagaaaa

SEQ ID NO: 121 - DNA, 694 bp, Mus musculus
  modified_base (41)..(41): a, c, g, t, unknown or other
  modified_base (52)..(52): a, c, g, t, unknown or other
  modified_base (76)..(76): a, c, g, t, unknown or other
aaaaaaaatcaataatgaatcttccctttccacaacactgngtcaacctttntaggttgcatgcactggcctaggnatgcgtgtgttggagagggtctgatgcttctgagtcctatggaaaggtgacagagggagagagtggaggtgacaggctaatgtgcactcaatttaatttctacattacaatttccatagaaagatacttaaaatataattcctaaaataagatattttgttttataaaacacagattactaatggagatgtattgcattatcttcaaatctgtcttcagcctcattctcatcatctatatgtagagcccacacagctccgacatagttggatagaaaaatggaatactctaccattaccttacttataactccatggagccaaaccagcaagtctgataatcatttcattgcagcttgtcattttaccttacaactctgtagactaaataaatagaatgcccagtattctgtgtgtaatatctagtatctgtacgttataatttcactatcacagtaaaaattttatgggaagcctcccccgctcttctttgtaatttataattatttatgtccccttaaaatatgtcatgtgagtttttctgtgattgggttacctcactcaggatgatattttcaatggcaaaatattttgtgacttcaataaaaatatattttcc

SEQ ID NO: 122 - DNA, 628 bp, Mus musculus
atgtttggaaacacgatttatcacatactatatacaatatttatgttgttcgccattcacaatgtctgagacacaaaatccctcttacactatacacgcttgttgacgctgacgtgaagactttgcctgctctgacaaggtcaagttctccacagaaacctcgtcctaaaaccagctttctcttcgagtcttcttcgtcgtgggctctactactggcaattttaagtctttacagttttacaaaaccgtcctttacttattaacgaagccacgaggatggaccttttccataacacaagaaatgtggactgatcataaactcaggaaacggtaggagtgtacgatgctttccgtgcgcagccgcaattgtctgacgctagtctgcatctgaggaagcgctgggtgtgaagatacgggaggatggttaaaagccagttggaggatggggtgtggagtggatgcgaggggacgagagaggagggcgtaggagaggagcgaatggtaaaggggtggaggaggagatggggaagagggaggtggtgagagagggagaggggagaggggaggggagagggagggagaggaagggagaggaggagggaggagggagagggagggagaggagaga

SEQ ID NO: 123 - DNA, 1051 bp, Mus musculus
aatgaataatagaagatgtttgttagttttcgcgaaggctggagtggtgggcgtgaatatttgaaagtaatgtgcggagctgaatggggggtaatagtaatataaaagatgtgaagtggttgatggtgtggaaaggaaatgaagcggagagcaggtgttatgagaatatttgagatgaggagattggcgagcgaagaggagaggaaagaagtgtagcaaaatacgttgagtgcttgtgagagggttagcattggaggggaaagtgtagtgtatttgttgctggtaaggtgaaggagggagaggtgggtggcagaagaggtgattgttagggagggggtgctgtgcagttgtggtcgggtagggaggtgaagaacggggggttggtttgaggaggaagacgtggggttgtgtggagtttggtggtgtggtagattaaatggtgcatttattatgttgaaggtatttgaggattgccatgtgtgcaaagaatcatgcgatggagccaaggaatatatgtcgatgttttttttttttaaagcgatggtttttatttttattttattttttagaattttgattaatagtgtagttatagaggatatgggtgattttatgataggttattgtgtatgaaatatgtttgtaaaatgaattgatgtttagtttgctttagggatttgaaaagatgccacacgaggaggtaaccaataagagcagagctccagattcttgtgcgtggagaaggggttggtggaagagtgatggaaaggggagatagaaaatggcgaaagcacagagcgtgattggtgtgggaggtgtgttgaggaaagagtagtaaggagttatagcgaatgttttggggttttttgttttgttttgtttggtttggttttgtttgtttgtttttaataaggaaaaagaaaaagagaaagagtgtaaatttgtaatcaagtgtttgtgaggaaaaacgtatgggttttggttatgtttgtttttgtaggtctatgtatcaaatatgacacttgtcttgcaataaagcttattttggggc

SEQ ID NO: 124 - DNA, 587 bp, Mus musculus
gagttttaggcatttattggaattttgaacatgacaatatactttagagggtatcccaaagctatctgaaagagggagaggcttgccatcattgcatgtgaaatggcacttggaaagtgcagagactcacactctcacgcctggggtatcactttcttcttcctcttttattttcatcagtcctaggccagggtgcgacccaaaagcattcttggttcctggcatcaggatgaggcagaaggtgcctgggctcaggctgtggtagagcttttcaatcttccggctccaacgccaagctactatctttgggtggttcaccttccgagtcctgaagatgtgcctctccatgagaggaggtacaattcgaagccccataggcattgctggttcaggatgtatgtccttgagccatgcctgaaggtgccttggggttagggcatttctgcctttcaacttccagtctttgcctttgagaatttcaagggctacctgggcactgttgacagttttaaacttcaggaaacagtagtttttttgctttctgcttttaacctctttaggcaggatcacagcttccaggtcaggga

SEQ ID NO: 125 - DNA, 415 bp, Mus musculus
gtcatgcccccaatatcttcaggacaccccattttgttgtgtcatactgcctctattcagtttcccttcccaagtaatttttttttttttgttttttgtttttttgagacagggtttctctgtatagccctggctgtcctggaactcactttgtagaccaggctggcctcaaactcagaaatccacctgcctctgcctccagagtgctgggattaaaggcgtacgccaccatgcccggcttccgatgtgtaacagcttgggaggtattcataatgaagtctttctcaggtgttttctgaattgagctgatctaaggagggggttcaaggtcttctgagagcccctccttgtcacaagggcaccgtgtcatagttggtcactaagaaataaactggtggaattcctggcttccccc

SEQ ID NO: 126 - DNA, 640 bp, Mus musculus
gagagagatcagagctctcagactattcaaactgcagatttggactactttcgtgccgctcctcacgagaggagcaaaagaaagggaaggtatttaaaaagcttaacctcaccccttttccaacaattggtttatcaaaagaggcccgggtgtagaacatggtcgttggaaatggtcattggaagaggtggagtgtaaataggcgtggaaaaatattaaatttctatttaccatttaaggaaactctaagtggaaccccttgattcgccactggttgatgaccctattggtattcttatgccttttcaagtatatctgaacaaatatataggtttctgggactattgttatactagggtaaaagagttactatgtaagattatgtttggttgtgaagtcatctaaaaatggctgaaagtgtcggtttctttcctttcctcaccccacattataaagccatttccagtgtatccttcgtgtaagaatgtgactctggcagaggcacacgcccacctgccccgggtgtttgtggagtcagacctggtcagggtacttgtgaagtcaccacgttgtcggtgtcattttgcagtgctgtaaaaattaagtgatgaacgaaaaaaaaacaagaaagagaaaaaag

SEQ ID NO: 127 - DNA, 415 bp, Mus musculus; identical to SEQ ID NO: 125

SEQ ID NO: 128 - DNA, 712 bp, Mus musculus
gggtggtgttcttaaaggaaaccctatttatagtggatggggggattttggtcccctattggatgtgtaaaaaagcaaagtttattcttcctgtggttccctgtagccccaattatgaatgccacgtttacaggatgtgagtgggtggcagtaaacaagggttggtgggcaggagtgtaccccctacatctcagatgtctgtacccagtcacacgaccaccacagacgggagcttcatctctttcagttctggggaaaggagcctaccagtccagaggaagaatatttttatcgaattaccacatttagctctctgtcctcaatattcagaaaagtattttttttaaaacaaggcagaatgaaaacgtctgccggctggtttgtttctgtataaatatatactagaatgtctttctggatgaagcaactcccgcaggccagagcctctttgatcttcttctatgggcagcagagtgagcagctgccctgctcccgccggtcctgccggccacccaggttaagccggtacagcagtggactcacaagggagctgtctttgtgtggagtcttgtgcagcctgtgatttctctacctcaactgtgtggcgagtaggtgtgaacctgagtgactgcagagaatgtatttatttaacagctttgtgtaacaaaaccagaaacaaatggaaacactaaataaatgtattttaaattat

SEQ ID NO: 129 - DNA, 422 bp, Mus musculus
ttccattagaagctgaagttttattataggataatagcacacaaagcacatctaaaattgatgtgttcaatgcacttttaataaaggtactgtaatgttaaaggtacagtttctaagtacaatataacaacatccatattagaatgaaaatcggagtatttaaaagacaacattaaatctctctttttttttttacagcttgtatttacaaaatgaatcaaaatattttttttctttaaattcaggactcaataaaataaacagctgggaatatgcaatctacgactgtgtagagaggactgaaaagaaaacccaatgtcatcgaaaagtggggtgagactctattaaagatcattagcaaagttttaggtccatactatggtttttaggaatcccataaatggtttgcatttctagtgtga

SEQ ID NO: 130 - DNA, 621 bp, Mus musculus
actgattaattgatttattaaaaaatatttatagacagcctgtgataaaccagatatataacagtcaactaccatcctcaataaatatataaagtagtataaccccagctaagacatcagggcataggacactgagttaagattgcaatgaaagttacagggagtgttttaggtactaattaggtagatataacaatatttatgtgatttctgaccatttgtcatttttaccaatttcatctccttacagatacactttgcataaatttggcacagagtcccttcaatgttttgttttttgtttagattatttctacaaatctgtcgattgcttcttggcctgacacttccagtctgttcattgtacccttactgaactaacagtccaaagttcctttcctgttctaatctactagaactcggtagggaaggagagaaatctcacctattccttttataagtttataagattttctcatataaaaggagcacaattttgcatcttactttttgtctagcagtcttttttccctcttgagtcacttgatagaaatctattgaatataatttaatcttttgggatgatttagaaccttcttgggcatgttaacagtagctagg

SEQ ID NO: 131 - DNA, 367 bp, Mus musculus
ccaaatattttactaaagcatttattttcttaaacaaaaatatacattaaatctcagatttacagcatatagaaataatttatgatttgcattttaaattattaatattgcacccagcagtgtaagtctttgacacatttgcattgccaacccttcccaccattcaaaaacaaaaaacaaaacaaaaaaaacaaaaacaaaagcgaaacttgaaattgacaaaattacacaagctaaattttccataaaaaaaaggaaaacatacaattctttttatttacatggtaaagttgtaaactttcagaaatttacctctaggagataggcatacattctttcatcatatctagacaatgcattataaaag

SEQ ID NO: 132 - DNA, 1285 bp, Mus musculus
ggagttactgggtacaagtttaggatctcaggaggggctgagtgacttggcgccacataagcagcaaggagcaaggggcctgagcaagaggtaccatatttacctcagtgtgtgaagatcatttgtccaggctggggcaggagagaacctgaggcccctgcaggaggtgcccaggggcctggccttcctgcaccttcagagagtgaaacatggctgcactctggctgctgctgctggtcctcagtctggactgtatgggggcaggtggctttgtggctcatgtggaaagcacgtgcgtgctggatgatgctgggaccccacaggacttcacatactgtgtttccttcaacaaagatctgctggcctgctgggatccagatgtgggaaaaatagtcccctgtgaatttggggtgctgtatccatgggccgaaaatttttcaaggatcctcaacaaagaagagagccttctccagcgtttgcaaaacgggcttctggactgtgcctcccacacccagcccttctggaatgcgctgacccacagaacgagagcgccatctgtccgagtagcccaaaccacaccttttaacacaagggagccggtgatgctggcctgctacgtctggggcttctatccagcggatgtgaccatcacatggatgaagaatgggcagcttgtcccttcccacagcaacaaggagaagacggctcagcccaatggagactggacataccagacagtctcctacctagccctaaccccttcctacggggacgtctacacctgcgtggttcagcacagcgggacctctgagcccatccgaggggactggacacctgggctgtcccccatccagacagtgaaggtctctgtgtctgcagccaccctgggcctgggcttcatcatcttctgtgttggcttcttcagatggcgcaagtctcattcctccagctacactcctctctctggatccacctacccggaaggacagcattagagagcagaacccggaaccaaggagattcagactcctgaggattccttaatgccccaacatcttcaggacaccccactttcttgtgtcatactgcctctattcaggtccccttcctgaaataaatattagtagtttgggggggtatttataatgaagtctgtcccaggtgggggagctgaggtgagctgaaatgaggtgggggttcaaggcctcctgagagcccctccttgtcacgagggcaccgtgtcttaggtgatcactaagaaataaactggtggacttttgatttc

SEQ ID NO: 133 - DNA, 489 bp, Mus musculus; identical to SEQ ID NO: 28
  modified_base (338)..(338): a, c, g, t, unknown or other
  modified_base (367)..(367): a, c, g, t, unknown or other
  modified_base (395)..(395): a, c, g, t, unknown or other
  modified_base (409)..(409): a, c, g, t, unknown or other
  modified_base (430)..(430): a, c, g, t, unknown or other
  modified_base (436)..(436): a, c, g, t, unknown or other
  modified_base (445)..(445): a, c, g, t, unknown or other
  modified_base (452)..(452): a, c, g, t, unknown or other
  modified_base (455)..(456): a, c, g, t, unknown or other
  modified_base (469)..(469): a, c, g, t, unknown or other
  modified_base (478)..(478): a, c, g, t, unknown or other

SEQ ID NO: 134 - DNA, 666 bp, Mus musculus
ttctttctaatttggtgagtacagaaatcacttagaaatcacctttcctttagtttaatttaacaatccactcccccattaaacaaatagcccgtcgtggaagagcatcaggaaaaacgtaacagaagacagccatgtttttcgaaactagtcccgtctcacttcacaaaagggaatccatccccacagtgagggttgaatggaaaataagatgtgccaagaacaagagtagccagcgatatgtgtctgttaatcaaatgtcaagaaatatgctggtgttatttttccatatttaactggcaaacataggcaaacaagagccaagagctttttaaattctatgtgtctcatcagaaaagtcgacagaatcttaggaagtgcccatttcctaaaggtgaagtgtatctgtcatccagaaaacattaataccatgggtccttggaacacacatgctcttgtgagccctgtcttaggtgggaggctatatgttgggaaaaaatgcatttgcactaggtgaatagggcagattgagaattactggcaagttacagttagagcttcctctactctttattgggaaaagcaaatcacaagtgtggttattcttggttcatcttctcttaacattgtaatgtttgagtatcattaaaataagcttgtcgtggc

SEQ ID NO: 135 - DNA, 277 bp, Mus musculus
caagctccctgtttcccctcaggtttttctcctggtaatagtcaccatgtataaatgtcttacataattatcctttataggatgttcttccttgatctagcacctactaattaatacttcttgtattctgctatcccatcaggcaactgttcatagaatgtgatgattttaaaagagcaaggtgatttaatgttagaaaactaactaccattcacctttcaagttttcacaccacttttatttcataagggaaataaaatcaagacatttctttata

SEQ ID NO: 136 - DNA, 642 bp, Mus musculus
  modified_base (54)..(54): a, c, g, t, unknown or other
  modified_base (67)..(67): a, c, g, t, unknown or other
  modified_base (141)..(141): a, c, g, t, unknown or other
tttttagccgtagggtgaggggttgaaatcatttatagtttcctcgtactagtntttattcattcancaatggcatcaggggattaaaacagtcagctggggggccaagatgttctgtgctgcttgcacatccccgcgggncagatctgggagtctcagggttaagattattagcagagcttctccgtgtgccgtgcctgacatcctgcagtaacttaccattgtttctggccacttctaacatgttctccttgacacaactgttcccgcctctcgccacatagtgatatctgttttttgaatacatcaaaaatgatccatgacataagtctgaggcatgagactagagagatggatcagtcatcaagaaccctcgctgctcgtccagaggttctaagctctgttcccaggacccatgtcatgtgggtcattactctgtgtactgcatgttcatccagctccagggaatctggtatcctcttttccctcttctggcttgtgcaggcactcatttgtacctggcatacgcacacacacaaacatacatagacacactaaaaacatctgggggctgctaagtaacttggccaccacgtgctggtctttgatatcatgtagaatcccacagtgggaggagtttgg

SEQ ID NO: 137 - DNA, 1047 bp, Mus musculus
ttgggttaggttgtggggtgttttgttttgttttgttttggttggcttttccttttgagccagggtctcactgtgtcttcctggctggcctgaaactcactgtgtagaacagtctggcctcagtgcagatgtgtctgcttcagacttccaagtgccaggattaaaggtgtgtaccacatcaccacccaacttgattctgtgcaacttttaaatggacccctcagctttattttcatttctaaattagtatacaacatttggtcgtttttagtcaaacatggcggcacacacctataattccagtacttttgggtcagaggcaggaggattggctacaagtttaaggagttccagaccagccatggatagtgagaccctttttcaaaaaggcaaaaacaaaccaaaagaccccatcccatgggacaaagatctttatagtcttggaaactatctccttgcttttgaaaagccggtctggacaggtgtttcttgttggtaacaagttggttggttcttttttattggcggcacaaaacatttgggagtggtaaaaggttttttaaaaaccttgcttggtgataaggacaaagttttgcttcagcctactgtgtgtgaatgagtgagttgctgaaagaactccttaccttactctagcccttcagagcagagcacaagtgtttttatgaaccctggtagtgtaatcctgattcactcaggatttggatcttctactcccagcaagtccaggaccaaaagaggtgggagcagacctgagaaacgctgtgcaaatgtgcaaccccatgactttatgtaagtgggtctgtgtatgcttgagcatctgtacctgtagctctcatgctttcttccagaagatcccttcctcaccctcagaaatgtccactagaaatgcaagagaaaataaggtccctgacagtgagattttattggttttgttttgattttgggttttagttttttggggtttgttgctgttgtttgtttgtttgtttatgtgcttcctgctccagacaactgtttataggatcc

SEQ ID NO: 138 - DNA, 672 bp, Mus musculus
ttgttccttttcttctgagaaaaaagacactcagatttactttagtcacatgatttatttggaaagagctgtagagatcaatagaggtcttgtgaccccctgattcagtgctttcatcactactgacccttaaatttaactgggatataatgtcaatttaaaaattatgtgagccaagcagtggtggcgcacacctttaatcccagcactcaggaggcagaggcaggcggatttttgagttcgagaccagtctggtctacaaagtgagttccaggacagccagggctacacagagaaaccctgtctcgggaaaaataaaattatgtgggccaggtaaatgtctagaaatggaattgtaggcaaagcagggcataaggaaaaaatttaagtagatgaataaatatttttaaggcatggaggaatggcagttgcttctcttgcaggggtcccgagttctattgccagcatcacatggtggctcagaactgtgtctaattccagttccagggaatctgacaccctcttttggacttcaggagccctgcatgcatgaagtcctcatacatacatgcagacaaaacattcttaacattaaaaagtcaataaatctgaaagatagtaaggatattgaaattggcaatgttgatgttattatcacttattactgtttgc

SEQ ID NO: 139 - DNA, 702 bp, Mus musculus
  modified_base (97)..(98): a, c, g, t, unknown or other
gtactgaacccggaataaatattttttttgaacccatataaccttttatttagttttaaataaaagcttaaaaaaaaaaaaaggattaaagagaggnncttgcttttcctatattaaagtgcacattctacacagtaggctgatggcaaaaataaaaacggtgaccatgaatcagttttccatgtaccaaaatgatggcagccttataaagagaaaatcgttttcctagaaaagcatacttcctctcagaacaagattacatagacaatcactagcttcctgtctcctcatgaaggaattacgttgcaaccactgtattcatagctagttctcttggtaattctgagaacacataatgtgaaatttgaataatttctgtcagaatacaatagaatatcaatttctgtgtagatggacccaggcaatctcaccgtaagctagaagactatggagggagggcttcatcatgagagaaaagaataaattagaacacagtctaagttcacatgttgccatgctcacccttccatgttaactataaactctttggatcttgccacataaatatgtaccatgcatctacattacgaattaatctgagccaaataaagtcactagagactttgacaaaaaatactttctacctttaatatcttcggtttaatatctctcttctttaaaattgcatcttgaatggtggcc

SEQ ID NO: 140 - DNA, 2815 bp, Mus musculus
gacatgaggagactacaggcctgggatcttcccgatcagaatgaaacccatgttgaaagacttttcaaatctcttgctggtggtgctctgtgactatgtcctcggagaagccgaatacctcctcctccaagagccagtccatgtggcactgagcgacagaacggtgtcagtgggtttccactacctcagtgacgtcaacgggacactgaggaatgtgtctgtcatgctgtgggaggccaacaccaatcggactcttaccactaagtacctcctgaccaaccaggcccaaggaacactccagtttgaatgtttctacttcaaagaggctggtgactactggtttgtaatgatcccggaagtgacagacaatggcacgcaagttccactctgggagaaaagtgcctttctgaaggtagaatggcctgtctttcacattgatttaaataggacagccaaggcagcagaaggcacctttcaagtgggtgtttttaccacccaaccgctctgcctgtttcccgtggacaagccagacatgctggtggatgttattttcactgaccgtcttccggaggcaagagcaagtttgggacagccgctggagatcagagccagcaaaaggacaaaactcactcaaggtcagtgggtcgagtttggctgtgcaccggtaggggtggaagcctacgttacagtcatgctgaggctgttgggtcaagactcagtcattgcttctacgggacctattgacctggctcaaaaattcggatacaaattgatgatggcaccggaagtcacgtgtgagtctgtgctggaggtgatggtactgccacctccttgtgtcttcgtccaaggagtcctggctgtttacaaagaagcccccaaacgcccggaggagaggactttccaggtggctgaaaacagactgcccctgggagagaggagaacggtgttcaactgcactttatttgatgtagggaagaacaaatactgttttaactttggaattgtgaagaaaggccatttttctgcaaaggaatgcatgctaattcagagaaatatagaaacttggggaccatggcagccgtggagcccgtgtagcaccacgtgcggggatgctgtccgagagcgtcgccgcctgtgtgtcacttctttcccctccagacccagctgctctggaatgtcctcagagacctctccatgctccctggaggagtgtgctgttttccggccaccaggcccatcgcctgtttcaccccaggaccctgtgaagtccaacaacgtggtgaccgtcacagggatctccctgtgcctgttcatcatctttgccacggtgctcatcactctctggaggaggtttggccgagcccccaaatgcagcacgcccgttcgccacaactccatccattcccctggcttccggaagaactccgatgaagagaacatctgcgagctgagtgagcctcgcggaagcttctcggatgccggtgacggacctaggggaagcccaggggacacgggcatcccattgacttacaggtgcagtgcatcagcgcctcctgaggatgaggcctcgggcagtgagagcttccagtccaacgctcagaagatcatcccgcccttgtttagctaccgccttgcccagcagcagctgaaggagatgaagaagaaagggctgaccgagaccaccaaagtgtaccacgtatctcaaagccccctgacagacactgtagtggatgccacggccagccctcccttagacctggaatgccccgaagaggctgcagcaagcaagttccgaatcaaatctccatttctggaccagcctggggcaggtaccggggaaaggcctccctccaggctggatggcatcgtgcctcctcctggctgtgcggtcagtcccagccagaccctgatccgaaagtcacagataaggtcgaccggtggcagagatggctcatcggagaggtgccactccagaagttccctcttcaggaggactgctagttttcatgaaaccaagcagtctcgccctttccgggagaggagtttgtcagccctgactccccgccaggtccccgcctacagttccaggatgcggacctgggaccagatggaggatagatgtcggcctcccagtcgaagtacccacctgcttccagagagaccagagcacttccaaggggcaggtcggaccagcagtcctttgggtccactctccaaatcctacactgtggggcatcccaggaggaaaccggacccaggggatcgtcaggccggattggtggcaggagctgagaaaatggagcctcaccgagctcacaggggaccgtcccccagtcacaggagtgcctcaaggaagcagtcttcccccattttcctcaaagatagctaccagaaagtcagtcagcttagcccttctcacttcagaaaagataaatgccagagcttccccatccaccccgagttcgccttctatgacaatacctctttccgcctcaccgaggctgagcagagaatgctggacctcccaggatacttcggctccaacgaagaggacgaaaccacaagtacactcagtgtggagaagttagtgatctaggctaggaagcagcagggttcacccagggtccttcacccctctggcaatatcccctgctcacatactttctgtgggctgcactgtacaaccgtgggaattagttcacccagattatatgtgtgcgcgcgcatgtggttttgattaatcaggaagaagtggtttatgctgaattttcctctctgttatcccttttctattggcttattactactaataaaa

SEQ ID NO: 141 - DNA, 617 bp, Mus musculus
cggccgccacaagacaggagtgcgttgtacagttcaaggacggacttttcagggcttggggtttgtgggatattttttgttttgttttgtttttgccacaagatcttcagtgtgtttgtttcagggtggaagtgggtgttatatgaagctgtcagatattttaaggaaatcttcctacaacagtaaatgaagacatctgtatatatgtgatatagtgaaacaaaagacatttctggtattcataaagataaaacaaggattttattcttcctgtgtctgtgatttaaactcggtaccatactctggcttttgtatttcaccctaagtttaaaaataaataaacaagatattttttaaagaatgcacaacatagtgtgtcttagcaaggacatgagtcatatgaagcagagtgagtagttgtcactaaggtccttgatgctcactgtaaaaacacaaagagttccatgaatactctagtaccacacagaagtaccacagtggtgctgtgtcacataggaccctgaaggattttctgagagttgattcagcttagatgggagctccctccctgcaactctctgccttcctggtgtcatcagaacttggtttgactccta

SEQ ID NO: 142 - DNA, 612 bp, Mus musculus
gatttattaagtttaactaaacacctcgtcctctgtccatgcttatgggccacctgtacatcttcttggtaaaatgtctttcccctcttgccaatttctaactagtttactggggctttcttacctggagactggaattctttattccagaggcaacaagccattttttaattgtggggcactaatttgagactattccatcccctaacaaaacccaaagatattcaagacccttgtccaacatggtatatttacatgtaccataatatgcctctaatattaatgatcttaaaatcttctggacctacaattggatggctcctcagatgaggaactcacgggcacagggcccacctgcactgctcttttactgaacatctgattggtgagttctttttcccactctgcagtaagtttggccattctataacgtggctcaggctggctgtgacctcctgacccttctatctccgcctcccaagggcttggattacagcacattagcatagttttcagatgagcaaaaagaagtaacagatgacaggtactgagactgcactacactctgtagcactctgtaggcatttatttatttatttatttatttatgta

SEQ ID NO: 143 - DNA, 549 bp, Mus musculus
attcggcacgcgggtttttttattttttttttttatttttttcagcgttccagacttaaaacgaagtcgtttatttcaattttgctttgcacattatgtttcggtacaatcaaaacttctggacgaaccccttgaaagtcctgcgaatgagcgcaatcgcgagtccggccgcccgggtttgtttggcgggtggacctcgggttcagaggcgctggtacaaagtgtcaggtgcttcgggcgccgcggagcatagcagctggagacatccaaggaaagtaggcgtgaagacagtcacgcggggcaggcgggttcgagtactaggattgggaataattcctgatgcatttggaattgagggtgagcaagaaactgcttccaggccctcggtcacgcctagcaggatttaggtcttatatctcactttccaccaaagcaggggacacaggaaaggcaaagggagcctgctacgggagacagcgcagaaatggctctgcgaagaaggccttgtgcctggcctctccttgaacttccaagttcttgcttctcgcc

SEQ ID NO: 144 - DNA, 978 bp, Mus musculus
  modified_base (77)..(77): a, c, g, t, unknown or other
tttatatacaagggtgtgccatgacattgtagcctggattgcatcttggtgtacaactaataagttgagcttggcanaggcactggtcgccctacatgtatgctacatctagacaacggttcattaactcttgtcctgcctatgtacatgagtcaagagggagcacaggctaacatggttttatatgggaaaacatgtcactctacaaattaatggcttatgtgtttattttttcaaacaactggaaagagaaaaatgttaagtgagtctcattccttaagcactctctcaaatgaggagttcctaaagcttactaagttaaactgatcttaagtctttaaggcttttggttgggagtcagtgtttcagcctatggtccaaactggccaagagcccctatgtcactcaaagatccttcttcctcaacctcccaactgttaagatgagaggcatgaacccttcctattgttacaccctagtttcagttgtttggcctggaacttctgttgctaagcaaatgtaatggtgaaagtctatgtatactctaaaagcaaatgaagtgctctttgtgaagtgatactttcaaaattaaatggaagctgacagttataggagaggttaagaattataattcatggtaaaaccacatggatgaagttatagacagaatggagtcttatgtgaatttgtactatgtaagttttactatatttgtgtgtgtaaagtaatcatgcaaagatgttttgccacagaatctgtgcttaatatgtaatgtaaatgcatagaaatgatacttgccaaactacacaaatctatatattctaaaataatcccatagaaatcttacatcagaacttacctagttttgatatttttataccctactaccaaagctggaaagagatcagttgatatctgggggctgcaatgggaatttgtacaaagcactactctttttcaataaattgttttttaatt

SEQ ID NO: 145 - DNA, 741 bp, Mus musculus
gtctctctgcaacgcagcgtgcgacccgtccgcagcagaggtgggtgcctgcccctgccttcgcgccgccgctacagccaacaccactgccaccatgcccaacttcgccggtacctggaagatgcgcagcagcgagaatttcgacgagctcctcaaggcgttgggtgtgaacgccatgctgaggaaggtggccgtggcggctgcgtctaagccgcacgtggagatccgccaagacggggatcagttctacatcaagacatccactactgtgcgcaccacggagatcaacttcaaggtcggagagggcttcgaggaggagacagtggacggacgcaaatgcaggagtttacccacgtgggagaatgagaacaagattcactgcacacagacacttcttgagggggatggccctaaaacttactggacccgagagctggccaacgatgagctaatcctgacatttggcgccgatgatgtggtgtgcacaagaatttatgtccgggagtaaaggtggccagcttgttcctgcttcatgaccggatgcgagttcccctgaggagtatgccgtggccccacactgccagtgggtctttactccacacacctctcccccatgaatattaggcaaccccattttccccatgacattgttgtagtgtcctcccctcaggctcttgttgccttgtgtacccttggtttggcatttgcatgattgtaccagtcattaaactggttggctgc

SEQ ID NO: 146 - DNA, 741 bp, Mus musculus; identical to SEQ ID NO: 145

SEQ ID NO: 147 - DNA, 5004 bp, Mus musculus
tggagctgcacatgcggctgctccctgttctgtcccgcccagccaccgtcgctcaggaacgggtccctgcagcccccagccgatggcaggacagtagtcgcctgtcaggggtcgtgaaggactgaggcagaggcagaggctcccgggcctcagatagtggttgtctctggaggccatgggctacccagaggtagagcgcagggaacccctgcctgcggcagcgccaagggagcggggcagccagggctgcggctgtcgcggggcccctgctcgggcgggcgaagggaacagctgccggctcttcctgggtttctttggcctctcgctggccctccacctgctgacgctgtgctgctacctagagttgcggtccgaattgcggcgggaacggggaaccgagtcccgcctcggtggcccgggtgctcctggcacctctggcaccctaagcagccctgggagcctcgacccggtgggtcccatcacccgccacctggggcagccgtcctttcaacagcagcctttggagccgggagaagatccactcccccctgactcccaggaccggcaccagatggccctcctgaatttcttctttcctgatgaaaaggcatattctgaagaggaaagtaggcgtgttcgccgcaataagagaagcaaaagtggtgaaggagcagatggtcctgttaaaaacaagaaaaagggaaagaaggcagggccacctgggcccaacggccccccaggacctccaggacctccgggaccccagggacctccagggattccaggaattcctgggattccaggaacaactgttatgggaccacctggcccacctggccctcctggtcctcaaggaccccctggcctccaaggaccttctggtgctgctgataaaactggaactcgggaaaatcagccagctgtggtgcatctgcagggccaagggtcagcaattcaagtcaaaaatgatctttcaggtggagtgctcaatgactggtctcgcatcactatgaaccctaaggtgtttaaactacatccccgcagcggggagctggaggtactggtggacggcacctacttcatctatagtcaggtagaagtctactacatcaacttcactgactttgccagctacgaggtggtggtggatgagaagcccttcctgcagtgcacccgcagcattgagacagggaagaccaactacaacacttgctatactgcaggcgtgtgcctcctcaaggccaggcagaaaatcgccgtgaagatggtgcacgctgacatctctatcaatatgagcaagcacaccaccttcttcggggccatcaggctgggcgaagcccctgcatcctagattctcccattccatcctggcccatgcccctgccccaggtttgggagccaggactcccagaacctctaaggtgcttgctgtgtgtaggaattgaggtatactggcgttgcagccacaaagagaaatgccccatgctatttattccccagtgactccaggatgacaaggcctatgtgacttcccagaaagaccttgagttgccaggacagttgacggagccccagggttgtcaagaagcagaaccttcttaggctccctgctgactggcttatggtgactcctcaacccttaggtccctcatcagatgtatcatttgttgcactaaaatgaggatccaagacagtaggccacaaaaagaaaaggtgcactccagattctaggggtgatggggggcttcttctctcctggctgggggtgccattaggttgcaacttaaggagagggtcaggtcagaggaaggcaagtccttgtggcaaagacctgggcaataacctaccaagtcaatatccttgacagaggaggcattcttgctgcattgcactataacctactagaggctcaaagaaaacttcccactcaggctgagaggtatactgtggcagcttgctggactccagagctgggaactttgctttggctttggaatcatgcaggaatgaccacatgcatgcctatgtaagaagctatatttggggtcatgcatgtctcattgtgtttacagctatgttccactctcagaaaactacctggagtcttcccacctgtcaccacccaccccagtctgactagaaattctatcttctttctcctcggtgcctacctctgctttagacaggtgcttcacagtgtactctttaaattacttgggcacaaagaattttccatttattaggcatacaattcttctaattctaatcaaactgtgtctgggaacagatggttaaactggataacctccaaaagcccttagagtttgaagatcggtggcactcagcagttacctgccacagtaaattttggaattcccaaaccctacactcccttgggcatcagcacagtatagcttttctccctttcccagggagggggagaaagtggggatagaacaggaaatgttgtccacttttgttgagacccaagctcttatctgaaagagcagcaggccatggcccactagcccagtctttctgaggtgctttcctagagcatctgtctgctattgagcagggctctcacacctacttcagatccaaaggcacctccaccagttttcctgcattgtcttatgctaggttcatgagacttctttccaattgcctagcttcagggtaccaggcacagcctaaagctggaaggatcaacctggtccagccggttcctcttgctcctgaaatgtatttctttttgaggagatgggaaatgcatccctgaaatgcatcagaatatcaggtactgagttcctcagctgtacctccagggcccgtagccagattgcttggtccttcacgggtcagggcaagaggtggtaggccaggactcttttatacagtgctaatgacgaccttacaaccagaaatgaggtcgattttagacatgcatctgcccttggaggccttgaacaatcagcagtggtagcaagaactaacagaccctctccttagtgtttgaaggttgcttcctcttaatttcctttgaagaagacggggcagagaattatcacagttaccattgtataggtacggctgggagagaaagcactttcattaagaactcacccataagtcacagaccttagcttttagtgaggtctgactcccgagctagtgtcttaccacacacttaccacacactgtgtggaatttgggttccgaaagaaaaattaaaagtgatcacatggaactgatatcatggcagagtcctagggagaaacctagcaatgctatggtactgcctagtctcttggctgccacaggctctgtggaagaagtcttggatgttttctaatcctgagttgagctctgggacccacagaacttggagccttcatgacctttcacccatctgataaaagcagcaaccatcacacaacgagctgctatgtggggcaaggtcttctgtcttccattcctgaccctagctactagttctgggagccagtctgcttcctggggttaggtgtgactcctcctctcctcctgccatattacaaaggccttaatgttgccagaacatcttcctctgttgatgttgagaggttgccctcccgagaatggagggaaaacctaagagcaccattccaaagccacatggctatggagaaatagaggaagtttcctaactgtgcccctgcaggacatgccaaccccatcatatgctctgtgcttggagatcataggggaagtgggcttctcactaccctgtcttcatcctgaatcctcacaaggagccccagatgcagaaggctgggggaggaaataagaaagaatggggggcctgctgtgctgtactcattggcaaagtaatgaagcatttactgataggaaaatagggatatagatttacagtttggaattgtcatgatgtgaagttatcccaaggttagcatagagaatgggatggggacatgtttgtgtaagcagatgacatgttagaagaaaaattgcaccgcaggagcctctaccagctgcttgagcttcaaaagccaagctggcacaaaattgtacctgctagatgttatgaggctactggttccctggaagatgtatcatttttgccttagttgcccctggacccatcctgagcctaatctctgcagcttagtaagaaaaggctaaggaccctagagatgagggctttggtcctcatgtgagtgattgcattttatgcgtcttctagtggatgcaaacagatgtagagaaatctttgactagaaaggtttttagagggaatgcagcccaacctacatcccatcctgttactcatatgcaattgatgtccagacagggaaactggcccacctaggacagtgtgcaggcaggcccccacctccagactcagcaggagaaggaggcaaagcaacctgtcccatggggcctcctctttcatacacccacagaatcaaagctagaagtgtttatctcccttcaggagcctggtgaggcagggagtgggtctacaatctccatcacaacttgcctccccacacatagtcccccaagatatttgtgcacctcctgcctctgggctggaagctttaggctggctctgagccagacagattttaggcttctcttgtgttgcctgaggtcccacccttgcctgggctttccctgggccatgcctactacagaacctgatttgttttcttaattcatttcagggctctctccaggagagcgtgaggtgtgtcatttctttcttcaaaaagcttccagctgatgaggataaggggagaatgcctggagcaggcccaatgctgctttggggaatcagcatcctgtgtgagatactgtgtatagaaactatatatataatgtatataaacagggatgtaagtttgtgtaaattaatggtttattctttgcaaataaagtgctcccctcaccaaaaaaaaaaaaaaaaaaaaaaaaaaaaaaaaaaaaaaaaaaaaaaaa

SEQ ID NO: 148 - DNA, 4339 bp, Mus musculus
gagagtctgggagaacaagttcaggggcaggcgacaaggtccgggtgctgagcaaggtggctggacaagcctagcgggagagaaacctgaggccacgagcgacctccggaggagcccctagacgggagtcttagctgagacacggcagcatgcaaccagcccagatgcgccttgcagaacgagagcctattttcaacactcttcccgcagtcgggcctgcacgccttcaggaacccaccaccactctcccaattgttccctgaaatgaacgttcctggcgcgccctctcgtggactgttgaagtaaccatctgtctctaggaagccatggcaaccacgcatgcgcagggccaccagccagtcttgggaaatgacactctccgggaacattacgattacgtggggaaactggcaggcaggctgcgggacccccctgagggtggcaccctcatcaccaccatcctcttcttggtcacctgtagcttcatcgtcttggagaacctgatggttttgattgccatctggaaaaacaataaatttcacaaccgcatgtactttttcatcggcaacttggctctctgcgacctgctggccggcatagcatacaaggtcaatattcttatgtccggcaggaagacgttcagtctgtctccaacagtgtggttcctcagggagggcagtatgttcgtagccctgggcgcatccacctgcagcttactggccattgccattgagcgacacctgaccatgatcaagatgaggccatatgatgccaacaagaagcaccgcgtgttccttctgattgggatgtgctggctaattgccttctcgctgggtgccctgccaatcctgggctggaactgcctggagaactttcccgactgctctaccatcttgcccctctactccaagaaatacatcgccttcctcatcagtatcttcaccgccattctggtgaccatcgtcatcttgtatgcgcgcatctactgcctggtcaagtccagcagccgcagggtggccaaccacaactctgagagatccatggcccttctgcggaccgtagtgattgtggtgagtgtgttcattgcctgttggtccccactttttatcctcttcctcatcgacgtggcctgcagggcaaaggagtgctccatcctcttcaagagtcagtggttcatcatgctggctgtcctcaactcggccatgaaccctgtcatctacacgctggccagcaaagagatgaggcgcgccttcttccggttggtgtgcggctgtctagtcaagggcaaggggacccaggcctcacccatgcagcctgccctcgacccaagcagaagtaagtcaagctccagtaacaacagcagccactctccgaaggtcaaggaagacctgccccgcgtggctacttcttcctgcatcattgacaaaaacaggtcgtttcagaacggggtcctctgcaagtgacggtctcaacagggcaagctctgcagccacacctatttattgcatgcatcacttccacgtggggccttaagagatcttaactctggaggtctgcttgctgtggccagactgtgtggtatctcctgaggaggagacccaaggagtcaccaacgcatttcagcctggacttggatgtgacttatctgttgcgggctccatccttctgaatgtaccaagctgctgacacggtgcactgccttcggatgccgctacccctggtccagggaaggcaggtggtgatgtgctatgcacatgcacattgggatgatgtctccctgcgttcacactacatttattttccatagaatgggtgctcatgtgtgtgtgtgtgtgtgtgtgtgttcgttgctgtgttgtacaggatgtatacgattgattttcccaggtggaacccattacaaagtgtcagtcttccacacatcattggtccaaacctgcccacactgctgtcccaggttcagcatgtgataaggtcatgtccccttcccagtgcccttgcactggtgttctaactcatagctgtgaaaagttactaaagtattctgtattctcaaaagcctcacccaagagcagcccaggtgtgtgggtcttacccttacattcctgcacccctcctccctcttgggtcccttgcgtaagcttaggtacacctaagagccaaattatgcgatcattgaggcatttctgaaagccacagaaaagccagccgggatctctcggaatgcaggcaccactaaaggaagaactcctaaggagaggcaaggtgctctccactgtgggcaatctttctaggggactgcagtctgtctgctgcatgtagagagtttccagcagtgacgttcacaagccagcccttcatctgtatggtcctgagttcaagtctatagagagaagcttgaggctgcttgtcccctttgctgtcaccctttgctggcaaggagctggagctgtcagcaaagcttctcaactccctcagttatggaccctgtccaggactattcagtgagaggattccgccaggctgggaggcgtgatgtagttatttgtgtgctctttagagagaaccattccaattcccatatgatggacactccagccactctcctccgcttggacctgcgttcatttgtccatcctgtaaagaaaatgcgtagaagacacctctgaacatcccctccccaaggattccgcccacagggcacacagatgaaaggtgggtgcgttggagagtggccagcatccatgctcccagaacagccttcggaaagactctcatttgaggaaacgtcatgtcaaggctccccataagttgattagtctcagagactgttgccttatgaaccctggaagagcagcctttacacactcatgggcctttttaaaactgatttttttttccctcttggtggttacctgatggcatttgctcttgtttagggacatttttctgggccttaggtaaccctggtctgactaactaaagacttcccctcatgtcactcctggtgtatataggtcactgccaagaagttctgctccatcattggccttgcccttctctatgtcaccaagaaaatgtcaccgtgttgacaaaacccatggcatttctggaaaaggaaagcatacaagtgctgggttaagggaaaaataaatagcagagcagtgtgtaggggagttgaggtggaaagagaacagggcttgtgggcacgctctttcatgattgcaaggctttgaggccgtgggtctaggtcactgatattaatcacacattgtacaggattctggcttctccatttcctcctgtgtctgctttcacacaacagcccttgtggagggccaggcccaccatccccagctaggaggtgacatttgtagcatgacagactgccaagcaactgaaaataaaaatacactaaaacccaattgcgctcacttgatgtatgcccagtggatccgtcgaccgtgatgccagtgtgcacacctttccctagctagcctccgagacagcactgagacatcgggtgcatccaaccctcaccctgaaggtcaaaggtcggaaaccagtgacaccagagaccctggggctcgcccaaggtagtgagcaaccttggctacttgcagtttatgtttgttaataataaataaaaccaaaagcctgtataaaaacccatcctggaggcctgtgtggtatgttctattgttttggaatagacactcggggggtgtagtggggtggtcttgcttctctccctagaacctgatctcacagcattacaggcataaactacatttgatgcccaatcactaagtcccttttatcccccagggccatcttgtagatgatgttagattgaagctttagcgtactggatgctactgatacaggtctgggtagatgctgttttactggtggtggtggtggtggtggtggtagcggtggtgagtgtgtgtatgtgtgtgcccacccatgtacactattgtgcatgcaggagaggccagaggttaatgttggatctctctctctctctctatgctctccatcttggtttttttgttgttgttttgttgttgttgttgttgttttgttgtttgtttttttgagacaccatttctcactgaacccgaagctgccagctttggctagattgactgaccaacaattccccccaggacctgtgttcctcctgtcatggttataggcacaaactgccctctgtggcatttacgtaggcacagggcatcccaggggagccatttcccagcagatcctatgatttgaagaatggtaatagcccctctgtagggaagaaattataaaataaaaatgtcatccaacc

SEQ ID NO: 149 - DNA, 3197 bp, Mus musculus
acttctccagcaatcagagcgctccccctcacatcagtggtatgcttcgcggagatatgctcctctcactgcccggtgcaccagcaacatggattgtcacctctccatcctcgtcctgctcggctgctgcgtcctcagctgctccggagaactgagcccacagccttccaacgaagttaatctactagattcgaaaacaattcaaggagagctgggctggatctcctacccatcccatgggtgggaagagatcagtggtgttgatgaacattacacaccaatcaggacttaccaggtgtgcaatgtcatggatcacagccaaaataattggctgaggacaaactgggtacccagaaactcagctcagaagatctatgtggagctaaagttcacactgcgggactgtaacagcattccattggttttggggacttgcaaggagacctttaacctgtactacatggagtctgatgatcatggcgtcaaattccgagagcatcagttcacgaagattgacaccattgccgctgatgaaagtttcactcagatggatctcggggatcgcattctgaaactcaacactgagattagagaagtgggaccagtcaacaaaaaggggttttatttggcctttcaagatgttggtgcttgtgttgccttggtgtctgtgagagtgtacttcaaaaagtgcccgtttacagtgaagaatctggctatgtttccagacacagtgcccatggactcccagtctttggtggaggttaggggctcttgtgtcaataattccaaagaggaggaccctcccaggatgtactgcagcacagaaggggaatggctggtccccattggcaaatgcacttgcaatgctgggtatgaagaacgaggtttcatatgccaagcttgtcgaccaggcttctacaaggcttccgatggtgctgctaagtgtgctaagtgcccaccacacagctcaacacaagaagatggttcaatgaactgcaggtgtgagaataattatttccgggcagaaaaagaccctccatccatggcttgtgcccgacctccatccgcaccaagaaatgttatctcaaacataaacgagacctcggttatcctggactggagttggcccctggacacaggaggccggaaggatattaccttcaacatcatatgtaaaaagtgtgggtggaatgtcaggcagtgtgagccgtgcagccccaacgtccgcttccttcctcggcagcttggactcaccaacaccacggtgacagtgacagacctcctagctcacaccaactacacctttgagatcgatgctgttaatggggtgtcagagctgagctcgccaccgagacagtatgccgcagtcagcatcacaactaatcaggctgctccatcaccagttatgacaattaagaaagatcggacttccagaaacagtatctctttatcttggcaagaaccggaacatccaaatggaattatcctggactatgaggtcaaatactatcaaaagcaggagcaagagacgagttataccattttgagagcaagaggcacaaatgttactatcagtagcctcaagccagatactacttatgtcttccaaatccgagctcggacagcagcgggatatggaaccaacagccgcaaatttgaatttgaaactagcccagactctttctccatctccggtgaaaacagtcatgtggtgatgattgctatttccgcagctgtggccatcattgtcctcacggtggtcacctatgttctggtcgggaggttttgtggctatcacaagtcaaaacacagtgcagaggagaagcgccttcactttgggaatggccacttaaaacttccaggtctcaggacctatgttgatccacatacatatgaagaccctactcaagcagttcatgagttcgcgaaggagttggatgccaccaatatatccatcgacaaagttgttggagcaggtgaatttggagaagtttgcagcggccgcttaaaacttccttcaaaaaaagagatttcggtggccataaagaccctgaaagtagggtataccgagaaacagaggagagacttcctcggtgaagcgagcatcatgggacagtttgaccatcccaacatcatccgactggaaggcgttgtcactaagagtaagccagagatgattgtcacggaatacatggagaatggctccttggacagtttcttacgtaagcacgatgcccagttcacagtcatccagcttgtgggaatgctccgtgggatagcatcaggtatgaaatacctctcagatatgggctacgtccaccgggaccttgctgctcgcaacatcttgatcaacagtaacttagtgtgtaaagtttctgactttggactctctcgggtacttgaagatgacccagaagctgcttacacaaccaggggaggaaagataccaataaggtggacatcaccagaagcaatgtcctaccgcaagttcacctcagccagcgatgtatggagttacgggattgttctctgggaagtgatgtcttacggagaaaggccatactcccagatgtccaatcaggatgtaattaaggctgtggatgagcggtatcgcctgccacctcccatggattgcccagctgccttgtatcagttgatgttggactgctggcagaaagacaggaacaacagacccaagttcgagcagatcgtcagcattctggacaaactcatccggaatccaggcagtctgaagatcatcaccagcgcggctgcaaggccatcaaaccttcttctggaccaaagcaatgtcgatatcgctaccttccacacaactggtgattggcttaacggcatgaggacagcacactgtaaggaaatcttcacaggcgtcgaatacagctcctgtgacaccattgccaagatctccacagatgacatgaaaaaggttggtgtcactgtggttgggccacagaagaagatcatcagcaccattaaagctctagaaacacaatctaagaatggtccagttccagtgtaaagtcctggagggatgtgagaaacgggaagatgcagcagcatcctgcagacagatggaaatgataaataagatgctgcagaagctccaagtctaataagacactcagttataagtccaaatgccttaaaatggaattgaaaaatctctttattttccc

SEQ ID NO: 150 - DNA, 574 bp, Mus musculus
  modified_base (423)..(423): a, c, g, t, unknown or other
  modified_base (444)..(444): a, c, g, t, unknown or other
  modified_base (447)..(447): a, c, g, t, unknown or other
  modified_base (514)..(514): a, c, g, t, unknown or other
  modified_base (528)..(529): a, c, g, t, unknown or other
  modified_base (554)..(554): a, c, g, t, unknown or other
attgtcaccttcaattttattcatcgctaaaaggatgatagttagagttccggggatgccccaggcactggcatgaaacagcaatgctttcttctcaatagcttcactgccccactttggcacagctgctaaaaaccatgtgatggtaagaattacccaccatacactgccagccatagtgaaaaaatatagtaccataaagagcatggtacaggccttattgtgagatccttgtgtcactgtagaagccttatactgtgcagggctagatgcattgcaggctactcggtcctccagcgaaaacccaatgaagaaaattaatgacaccatcatgtagcagactgcataaaatatgataggtcttcgggtaacggaatcttgtgaacgtcaattagaaaggttaaaaagtaaacaatgtggcanagaggcaaatgattgaaatanggnctatgaaatagcgaggcaaatgaacagttcttctctccgaagtaacatattgggactggtggggaanaattctcgcacgtnnagaaagggattagccaagattaggnttcaatttttaaatctctgg

SEQ ID NO: 151 - DNA, 442 bp, Mus musculus
  modified_base (261)..(261): a, c, g, t, unknown or other
  modified_base (268)..(268): a, c, g, t, unknown or other
  modified_base (290)..(290): a, c, g, t, unknown or other
  modified_base (350)..(350): a, c, g, t, unknown or other
gcatagaaattttctttaattctgaaactttgttttattaacagagctaccagaatgtcatttcacaactagttcatattatatgaaaattcactacaaagcagtcaccacacatagaggatttttctagatataaaataagcatgtttataaaaatgctcaccagacaatcatctcttcacagcctagaaagaattacttttgtgatgacatgatccttagggttgggatgtgttcacaccccagggttgatgtgatacnaagaggnaagatctacttttccagtgggnacactctggccaagaaagcagagcgacagtgagttacagcagccagccaacgcgaagggnaaaactaaaacctgctttcaacagcacacatttcaccttagacaagactaaggcactgggttcctcctcctcaataacacgggtcatgcggt

SEQ ID NO: 152 - DNA, 357 bp, Mus musculus
aaacacaggtgcaaaaggaggggactatgctctggctccaggctcccagagctctgatatgtctctcccagattgtaaagtgtgaagacagctgcctggtgtggacttggtgacagacaatgtcttcacacatctcctgtgacatccagagacctcagttctctttagtcaagtgtctgatgttccctgtgagtctgcgggctcaaagtgaagaactgtggagcccagtccacccctgcacaccagcaccctatccctgcactgccctgtgttcccttccacagccaaccttgctgctccagccaaacattggtggacatctgcagcctgtcagctccatgctaccctgaccttcaa

SEQ ID NO: 153 - DNA, 450 bp, Mus musculus
acttgttaaatagaaactgaaactactcttgaaaaacaggcagctcctaagagccacaggtcttgatgtgacttttgcattgaaaatccaaacccaaggagctcttcaagaaaagcatagttcttctcgttcttgttccatcctaaaagcagatgttttgccaaatctccaaactagaggacaaagacaaggggacaatgaccatcaattcatctaatcaggaattgtgatggcttcctaaggaatctctgcttgctctgtattctttatgtggaataatatcaagaaatttttcttgtgaggaaattcatttgggggtgtgtacactagtgctgtactagattcccacagaacatctagcaaaccaaactgatacaatctgctccctattgtttgaggacccactgagtaatggtttgtggctattaaaatgcattatcattatccacc

SEQ ID NO: 154 - DNA, 659 bp, Mus musculus
agagtttcattatgccagtgtaacatatgctcctggcggtcttacaaaaaaattgaagcaaccttctagaaatatttttaaagagaagtccagagatgatgttgggcactagtaatttttaacagtacttggtattgtttggtccaagtttgcctgccttgcaagagtctgcagctgcttctagcacccagactctgggaactgttgctacatctgtatcataacgagtcaggatcattgtgttatgaattataaataaaacctggagcttggagccgggcagtggtggcgcacacctttaatcccagcacttgggaggcagaggcaaacgaatttctgagttcgaggccagcttggtctacagagtgagtgccaggacagccggggctacacagagaaaccctgtctccaataaccaaaaagaaaaaagaaaaagaaaaacaaaacaaacctgggtctggtgtgatggctcagtgggtgttagaacacttagttctctcgtagaggatctgggttcagttcccagtgcccacaggatgattgggaaaccgtctataaccccagttccaggggatctggcactcttctttctaacctttgtgggcatcaggcactcgtgtcacttagtatacatgtgtgcaggcaaaactctcagatcc

SEQ ID NO: 155 - DNA, 641 bp, Mus musculus
tttttttttaatgctcattttaacgtttatttatggtggggttgcatacatgttttgtaaagggtgctaagtgcctacactgagaacagtccagttcaaatcagtccattccacatggatgcttcctgtgccagttgaagtcatatggagaaaggccttgacctttctcttgctcaggtctgcgttgctgttaagtcctgctaactctccagggccttctttgtcgatacagatcatcagtcccatacaaagaacaagatacagaacacctcaatgtatttcacaagtttagcacagcacatctcttgttcaaaaatgcacgaaagcacaaaagtgaaagtgccaaatacttatcacacatgcatcaatcttaaacactacacgagttcacaaatgaatagcattacaaggttcaaaagcactgtgtggaaaacttaaaaattatacatgaaatactgcactgtggatttgggatactctaatgactcaaccccacccttacacagccctagtatgggtcagaaactatcaatgtgcccctggacctttttagtcctcaaaaacactgctgcggggggcctggggcagcagaatagccttccccagagctctggcctgctcacaaccctcctgtatctgga

SEQ ID NO: 156 - DNA, 1765 bp, Mus musculus
cggacgcgtgggcgctccaagagctccaagccgcatcggtcctgctctgatccgaaggcgcagacatgtcggaacaaagtaaggacctgagcgaccctaactttgcagccgaggtccccgactgtgagatgcaggacagcgatgccgttccggtggggatccctcctcccgcttctctggccgctaacctcgcagggccaccgtgcgctcccgaaggccctatggcagcccaacaggcctcgccaccgcccgaagaacggatagaagatgttgaccctaaaatcctgcagcaggccgcagaggagggccgcgcccaccagccccagagtccagcccggccgatcccagcaccgccagcccctgcccagctggtgcagaaggcgcacgagctcatgtggtacgtgttggtgaaggaccagaagaggatggtcctctggtttccagacatggtgaaagaggtcatgggcagctacaagaaatggtgcagaagcatcctcaggcgcaccagcgtcatcctcgccagagtgttcgggctgcacctgaggctgaccaatctccacaccatggagtttgccctggtcaaagccctcagcccagaggagctagacagggtggcgctcaacaaccgtatgcccatgacaggcctcctgctcatgatcctgagcctcatctatgtgaagggccgcggggccagagagggtgcggtctggaatgtgctgcgcatcctggggctgaggccctggaagaagcactccaccttcggagacgtgaggaagataatcaccgaggagttcgtccagcagaattacctgaagtaccagcgtgtgccccacatcgagcctcccgagtacgagttcttctgggggtccagagctaaccgtgaaatcaccaagatgcagatcatggagttcctggccagagtcttcaagaaagatccccaggcgtggccttcccgatacagggaggctctggagcaggccagagctctgcgggaggctaatcttgctgcccaggccccccgcagcagtgtctctgaggactaaaaaggtccaggggcacactgatagtttctgacccatactagggctgtgtaagggtggggttgagtcattagagtatcccaaatccacagtgcagtatttcatgtataatttttaagttttccatacagtgcttttgtaccttgtaatgctattcatttgtgtactcgtgtagtgtttaagattgatgcatgtgtgataagtatttggtactttcacttttgtgctttcgtgcatttttgtacaagagatgtgctgtgctaaacttgtgaaatacattgaggtgttctgtatcttgttctttgtatgggactgatgatctgtatcgacaaagaaggccctggagagttagcaggacttaacagcaacgcagacctgagcaagagaaaggtcaaggcctttctccatatgacttcaactggcacaggaagcatccatgtggaatggactgatttgaactggactgttctcagtgtaggcacttagcaccctttacaaaacatgtatgcaaccccaccataaataaacgttaaaatgagcattaaaaaaaaaaaaaaaaaaaaaaaagggcggccgctcgcgatctagaactagtcttaagcggggtgggagggcaagggagggtgccctcctagtggggtttggggggattgggttcctgaatgcaccataattgctgtatgaaatattaaaaaaaagtctaaagttcaaaaaaaaaaaaaaaa

SEQ ID NO: 157 - DNA, 381 bp, Mus musculus
caccccaagcctaccaaccataaaaaaatacatatccatataaaaaacccaccataattctcacttttcactctctatcctgcctatcctccattcttgaacaacacatctcctattataaaactgtaaaatactttgaggtattctctttcttattttttctttccgagagatgatttgtatccacaaagaagcccctcgagagttaccaggacttaacaccaacgcagacctgaccaagagaaaggtcaaggcctttttccatatgacttcaactggcacaggaagcatccatgtggcatggactgatttgaactggactgttctcagtgtaggcacttagcaccctttacaaaacatgtatgcaaccccaccataaat

SEQ ID NO: 158 - DNA, 236 bp, Mus musculus
tcggtcccataatttgctttgatatagaaggccctggtgacttagcaggaatttacaccaacgcagacttgagcaagagaaaggtcaagccctttttccatatgaattcaactggcacaggaagcatccatttgggatggactgatttgaattggatttttttcagtgtaggcacttagcaccctttactaaacatgtatgcaaccccaccataaataaacgttaaaatgagcaag

SEQ ID NO: 159 - DNA, 670 bp, Mus musculus
gatgaagctgacagaaccccaccaagtttatgtgcagattttaaagaaattgacaggccagaaggcaacagccaatcatgcagcagaactgctggcgaagcaattctgtggccaagggtcccagaaggaaaccactgtactgctcgtggatgagcttgaccttctttggactcacaaacaagatgtaatgtacaacctctttgattggcctactcacaaaggggcccacttgatagtgctgaccattgccaacaccatggaccttcccgagaggatcatgatgaaccgtgtgtctagccgactggtgagtccagggtgctctgcaaaaatgaaaatataaagcactagtaaatacgatttttgctataactatcatttttgtgctggaatgagaaatgttgcttgcccttttctataaataccataccttggctttctggtctcacaaagtactagaagtttagttacttttaaaaaataaaaagtatttaagcctgccacctcttcggtacttagaataaagcagagaaccagaccaactgtctctgccttcgtgggcttatggttagtttgtcaggaagcaccaccatcagaccgtgaagaacgtggtggtaagggaaggtgggagctgtgatttccttacagcacctctgtcttcttggaagattct

SEQ ID NO: 160 - DNA, 1331 bp, Mus musculus
gcagccagctagtcagccaggacctctgcaagccaaaaaatgtcgtcccagcaatatcagcagcaacgtagaaaatttgcagctgccttcctggcattgattttcatcttggcagctgtggacactgctgaggccgggaagaaagaaaaacctgaaaaaaaggtgaaaaagtctgactgtggagaatggcagtggagtgtgtgcgtgcctaccagcggggactgtggattgggcacccgggagggcactcgcactggcgccgagtgcaaacagaccatgaagactcagagatgtaagatcccttgcaactggaagaagcagtttggagctgagtgcaagtaccagttccaggcttggggagaatgtgacctcaataccgccttgaagaccagaactggcagcctgaagcgagctctgcacaatgctgactgtcagaaaactgtcaccatctccaagccctgtggcaagctcaccaagcccaagcctcaagcggagtcaaagaagaagaaaaaggaaggcaagaaacaggagaagatgctggattaaaagacgccaccgtctgtggaccaggaaaagggcatcagcaaacaggatcagttaattattccatttatacctactgtaggatttttattcaacagttatctgtagcttaagtacatgataggcaaaaacaaagagaaaagaaatgtttttgtagtagtggttttttgtttttttgtttttttttaatgtataccatagtaccagtaggggcttataataaaggactgtaatactatttaggaagttgaactctgtagtacataataggaggtaggattgaggtaagttttttggtgttgttattttgttttgtttcattttggtttggtttggtttttgaagttatgtgatatttcacatttaaatcttttttcttttttacattttttctcttgtgcatcaatttaaatgttacaaccatgtaaactacttctcttgttagatagattttcacctagactttttttcccaattcagaaaaaaatacacagtaaataaagcagcaataaaatataaatcattctattggagagaaatgcattgttttctgccagtggatattttctttgaaagtttgcagactgagaggagagaggcagagcaacgatgtagtgaaatgttgatctttgttttttttttttaagataagattgaaacatgaaatcctttcactttggcagaaaaacatttgttttcttgatgaaattatttttacatctgaggaaaaaaatctaggaaaataaaacaagtgatgctgaattaaaaaaaaaaaaaaaaaaaaaaaa

SEQ ID NO: 161 - DNA, 2130 bp, Mus musculus
cccacgcgtccggttcccgggtagtataaagattgcagtctcctttgttcgccctcgttgcgcagtcgtcctagcgtcatttctgttccgttctgaaaatcggtagctgtcactggtgcggcgctgctcgggaggtccggtcggcgagctcagaggagcttgagaccgtcgcagtcccctcggacccccatcggttaagaggaaaaatggttgaagcagatcgcccaggaaagctctttattggtgggcttaatacagagacgaatgagaaagcccttgaggcagtgtttggcaaatatggacgaatagtggaagttcttttgatgaaggaccgagaaacgaataagtcaagaggattcgcttttgtcacttttgaaagcccagcagatgcaaaggatgctgccagagacatgaatggaaagtccttagatgggaaagccatcaaggtggagcaagccaccaaaccatcatttgaaagtggtagacgtggactacccccacctccaagaagcagaggccctcccagaggtcttcgaggaggaagaggaggaagtggaggaaccagaggacccccctcccggggaggacacatggatgatggtggctactccatgaattttaccatgagttcttccagaggacctctgccagtaaaacgaggaccaccaccacgaagtggaggtcctcctcctaaaagatcagcaccttctggaccagttcgtagcagcagtggactgggaggaagagcccctgtgtcccgtggaagagatggttacggaggcccgccacgaagggagcccctgccttctcgaagagatgtttatttgtccccgagagatgatggatattccactaaagacagctattcaagcagagaatatccaagttctcgagatacacgagattatgcaccaccaccaagagattatacttaccgtgattatggtcattccagttcacgagatgactatccatcaagaggctatagtgatagagatggctatggtcgggatcgggactattcagatcatccaagtggaggttcctacagagattcgtatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgcgtgggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactaggaacaaacaaaacttttggaccaaaaaaatccccattcaaagcaacaaacaaaagtggaaactttctgtcataaactacccaaggactactaaaaggaaaaattgtgttacctttttaaaatttcctgttcccttttaataatttttatgttcttgtgagggaaaaagtaagacgtgtttaattttatttgctagtatgagctgctttcaacaagcaaatggtagatgtgtgagccttgacttgttcctagtgttgtaattttccaagtgaaagtgtccctgaaggccagccacttcctgatttttttccccagtaaatgaggcaagcaaccccaagatcatccacaaacttccagccatctagatggcctctggtctccactgagagctgaatcgccctgcctgtgcagacaagctagccattagagagggttggttgggtgtgctactttcagtatttcagggtgtcttccaactgaaatctcaatcttcgcagtatatatattaaaaccaacgagcaaacctgagctccgatgcctaggatgtactgtttacccagaaaccccccaaaaaagcagatggatactggccatattttgcttttttgacacttccttgggaatctacaagaacctcccttccccctccccgagtaagacctaagaccatttaagtgtgtgttaaacaactacaaaatactcaataaaacgtttggccaaagtcaaaaaaaaaaaaaaaaaaaaaaaaa

SEQ ID NO: 162 - DNA, 1105 bp, Mus musculus
aggtttgaaggaggcctggggagccgaggtaatgtcaggtggacataaaagttggagtaaatttttttaaccttgtgaagtctcacttttaagtccttgccatgttgactttttttaattctgcactttggcaaacaatgatagcacagcaggaggtgcctggtgtggtgggcagagcagtgtctagggggttgaagggcctggggcaatgcctgtgccccgtgtgacctgctgggagatgattacagctgacttcgaatgcagacaaggtgaatggaggctcttgaaggggctgtgcacagtgtttgtagagcctgggtactgagggttctgttggtcctgtgtgagagggtgaagaacacatctttaatgccagcactccctgaggcagaggcaaacaaatctctgggcttgaagccagcccgatcaataagttccagggctacacaagaaaaaacaaaaaaaaacctgcctggaaaacaaaagggtgaagctgattgggaggtgggtggtgggtattgggagtttgaggagagagatttcggggtgagttcctccagaggtgattgcaagctgaccaacaaagggtgaaggacagggaaggtttctgtattctttaattttttttttccctcttttggtttttggagacagggtttctctgtatagccctggctgtcctggaactcactctgtagaccaggctggccttgaactcagaaatccgcctgcctctgcctcccaagcgctgggattaaaggcgtgcaccaccacgccgggcagatttctgtattaattaagaagtgtcttctgctcactcaaggtgagaatttgaatatttggaagcatataggcatgtgctggaccagaagtgcttgctgcccttgtctgtgaggcagtctagtactgtctgaatcccagtccctccaaactgctttaagtgttaggagtcggttctttataatttaagttagtgcttaagtcagaaggcaaggtgggcgtggggccacactttgtagctgagcataggtcccttgccttgtcaccataaccaacctggcatcatgcacctttagaactcacagcttgacagtaaaacaggctc

SEQ ID NO: 163 - DNA, 1288 bp, Mus musculus
ggcacgagcactttcgggacctgtctccggatttcttctgaagacggtataattttgggacctcatctccagatctcatttaagaactactgactcatcaagaaatgacttacaaaatgaagaaagaatatgccttttgggccactgtgtgtctgttgcttagccttgttcccgagtttcttaatgctctgtctgaggaagctgatgacacagattctgagctggggtcaatgaaaccgctgcatacattttgtgcaatgaaggcagatgatggtccatgcaaagcaatgataaggagttattttttcaatatgtatactcatcaatgtgaagaatttatatacgggggatgtgaagggaacgagaaccgatttgataccctggaagagtgtaagaaaacatgcataccaggttatgagaagacagctgtgaaggcagcatctggagcagaaaggccagatttctgcttcttggaagaggaccctggactctgccgaggttacatgaagaggtatctttataacaaccagacaaagcagtgtgaacgattcgtgtacggtggctgcctgggcaaccgcaacaactttgaaactttggatgagtgcaagaagatctgtgagaatccagtccactccccttccccagtgaatgaggtacagatgagtgactacgtaactgatggaaatactgtaactgatcgcagtactgtaaataacatcgtggttccccagtctcccaaagtgcccaggcgtcgggattatcgtggccgtccctggtgtcttcaaccagcagacagcggattatgtaaagccagtgagagaagattctactacaattcagccactgggaaatgccaccgatttaactacactggatgtgggggaaataataataattttactaccagaaggagatgtctgagatcgtgtaaaacaggtctcatcaaaaacaagtcaaaaggagtagttaagattcagagaagaaaggcgcccttcgtgaaagttgtatatgaaagcattaattagtgctaagatataagcagcattaaatttttacattagtttacataaatattcctatacggtgcttctcatgtgatttctattcttctagaaaccagtgtcttgtttccattggtgaccatctattagaagatatattttcgccagttatgatcacaaacattacatcccttgacagtctaaaccttttcgaatgattttaatttttaacaatgtgagaaataaaatctttcatcctgagcaaaaaaaaaaaaaaaaaaaaaaaa

SEQ ID NO: 164 - DNA, 452 bp, Mus musculus
gtagcttctgctgacattctggcaagttgggtttccataaatagacagctttagcagagctcataccaggccttctacttcctgtcaagaatgctggcaagaaacaagaatgtggcacttcctttgccaaaatcacagacagcactctacctacctactaaatctcgtcacagactatcttgagtctagtcaaagacaatcgttgtcccagacggcagagccctccagagaaacacttctcagacatctgcagatccttttacaagagatgaaatggacaacttcactctgtcagccaattcttttaaataacatatgtactgaataaaataatagaaatttaagtttttgaaattataaagctacaaccaaaacttatttgcatattaatacagtactaatttatactattagtttttttttttaagatttctgtttcttaagagagcagg

SEQ ID NO: 165 - DNA, 1369 bp, Mus musculus
ggaacgttgctagttcgcgggtccaactgctggggccccggggatcactctaagccgagcgctaaaacaggagtctggaaggcaggcagcgcttcaattaattcaagcattcaaaactcctgaatcagtggacaccatgcataggaagcaccttcaggagattccggaccagagtggcaacgtcaccaccagcttcacgtggggatgggattccagcaagacttctgaactgctatcaggcatgggtgtctcggccttggagaaggaggaggtggacagtgagaacatcccacatggactgctctcaaacctcggccacccccagagccctccaaggaaacgagtcaagggcaaagggagtgacaaagactttgtgatcatccgtcggccgaagcttagtcgggagaactttccaggtgtctcctgggactcccttccagatgagctgctccttgggatcttttcctgtctgtgcctccctgagctgctgagagtctcgggcgtttgcaagaggtggtaccgcctctcgtgagtattcttcagccttctgggcatagagaggggagggaaggaagagggttatgtgctcatgtgagtctgaactcacatagaacatagctgaacctaagcaaatccagctcctttttactgtcattcaagtcagggaagtcgcctcacagtcagatgagaggagtctcctgtgggttactcttaccctatttctcatagcctctgttcagttccgcacttgtttgccagggatataccagtttaggctgggtggtgtgctgagagcaaaggagagctggagggcggcaagatggcccagtactgaggacccggctgagagcactggagaagggtacaagtctctgaccttggacagtgtgagcccagactgttttacatatgctctccatgtcctggacaagttacctgtcacttctgagcctggccatgctgtgtataagatagccataattgacccttcattgtgggatactcctaaggataaaatgaaaggtgcccgtatcttgcctggctcgttgggcctgctaaacaagggccactggaggtagtcttagctggttcttggctacacttaacgtgtgtgtatgtaaagggtgtgaaccaggaaggcagtgactagcaggaaataaggaatggctttgttgttgtgtgggatgctcaggagtttacccagtgcctcagatgaggcaagagctcttatcactgagctacacacagctgcaggcctaagcctgcacagttgtcttggtaggtgagaaaggtttccacaactctggctacatttcatttccaccaaagaggcttatttttttcaaaccaagcaaaaaaaaaaaaaaaa

SEQ ID NO: 166 - DNA, 757 bp, Mus musculus
  modified_base (535)..(535): a, c, g, t, unknown or other
aaaatataccaggattccacaggaggtggagaaacaggagagaccttgcagaaattcttgcaaaaagacacacctgcaaagaagataccagccaacaaaagggttcaagggcctagaagacgatcaagagaaggccgttctcagtgaaaacccagaggccagaccacagagtttatataatcctaaatcaacgatctgattttaagggaaattgtaagagccaccacactgacttcagaatctgaaatgacaaccaacagaagccaatcttcaagcaagtccaaacacagagttcatgtctttgtttctgcatgagaaatataagaaaatgatagctagtctcctgtggggtaggaactgaggaaatataggaccatgcagggattttatctcaatgagaaaacttctgattaaagtagaatccaccaaagaacatcattgtgactgggtccatacagctaagtctttgcacagtaaaaaccttccgcctcaggaagaggctggaaaaacccaaagcacacagttacctttccangggaggctaaggtatcaaaaggggtgttcagttatacaacatgcaaacaaacctaccaaattacgaacagtggtgttacatatttctcatgcaatgtgggtttcctgctaaattttgttatttttacacttgatttatatcctcgagatgattgtcataagcttcttgcaatacaaatgttttctctcaaacatttcaataaaaccattcttcaggtataaa

SEQ ID NO: 167 - DNA, 530 bp, Mus musculus
ttttttttttttttttgctaactgagaaagggtctcactatccagggctgacctcatccttggagatctacctgcttctgcctcctgagcactaggactaaatgcgtatatgtgccaccatacctagctcaccactcttctatccatttgggtcactatattactagtcttaaactacagagaagtactgaaagatatttatgacacacacaatgaagcaaaagacatactgagtttatatcacagctttactaaaaataacctggcagctgaaataaagttcaatgaaagatgtaaaactcagcttttttttttttaaagatttatttatttattatatgtaagtacactgtagctgtcttcagacactccaaaaaagggtgtcagatcttgttacagatggttgttgtgagccaccatgtggtcgccgggacttgaactccggaccttcggacgagcagtagggtgctcttacccactgagcgatctcaccagcccaaaagtctcatgcgcgggcctacctcttgccg

SEQ ID NO: 168 - DNA, 737 bp, Mus musculus
  modified_base (660)..(660): a, c, g, t, unknown or other
  modified_base (703)..(703): a, c, g, t, unknown or other
ttttttttttttttttttgcatgagttcaatacacatccatttattaatgcatatgtcagcaattgcgtcatactaggcatttagaaaagtcattaacaaagcagtcgcctaagatttgaacacaaattagccaatctcaccagcttgtgtgttttcagacccagaagcagaatggttgagagagatggcactaaatcacttctgctcctcacatattagaccagcatgtttatataacacagtcaacaggacagcttctcaatcctggccaagtggggaatctcctcacagccgtggctgtgagttacaatgacaaaatgatgctttgcagccaaatatttaaatacagaccctggaaagtcagataacaaaatccagacaacgcaagtatctgtaaccaagttgcatttggggcatataaagaacacgagttacaaaatcatgagccatttacttttagtttattttacatttttccctcctaaatatatacgaagttgtgactttggttttctgcaatctacagtagtgctgcattcagcataaaccattgaatatttttaaaagagacatctggatgtagagttaagtagtcataagtatattgttagtattttccttctaacaagttacttatcttgcattccatgactttccanagaatgaagtagggtaaagctgagacataatgctacacagcanactcatcagggttacattttttttcttttttttt

SEQ ID NO: 169 - DNA, 863 bp, Mus musculus
gcggcgccagcccgcaacatgggcagccttttcgggcgcgtcgcggcgctgcgggcgctgttgtgcgggccacgctttcagtgcctgctggtgcgccccagttccggaggccccccctggccccaagagcggacgctggttgctgtgaagccagatggggtacagaggagactagtggggactgtgatacaacgctttgagaggcggggcttcaagctcgtggggatgaagatgctgcaggcaccagaaagcatccttgctgagcactaccgggacctacagaggaagccattctacccagctcttatcagctacatgagctctgggcctgtggtggccatggtctgggaaggccccaatgtggtccatatctcaagggccatgataggacacaccgactcaacagaggcagcccccgggacaatcaggggcgacttcagtgttcacatcagcaggaacgtcatccatgctagcgattctgtggatggggcccagagggagatcgagctgtggtttcagagcagcgaactgttgaactgggcagatggtggtcaccacagcagctgctaccctgcctgagggcttgcactgccttctgcacttcaggtctacccatgacctactacctctgtcaacaagaagtcaagcccccatgcttcccatgtccccaaaccactccctactcccgctctacccaactccagcccaggggagtctaagcctcaactctatgtgcctttttgtatcctaagtcaatacaatattggaccatgtccttgtgtacaaaagtgccagacaacctttggggcattgtcaaaggtgacttcacctgcctcaaaggagagacattaaaattttatgct

SEQ ID NO: 170 - DNA, 331 bp, Mus musculus
cacagaaagccatgctaattttattaacttatataatgcatgaagtctataatttaaaactacagaggtttactacaaatcagtaagaaaatacaaataccctatatattaatcaggacagaagccaaatacaactatcttaaacaagaaagggactttattggctcaaaaaactttaaagtccagaggtagggcaggctttaggcacatctggatctagggcccccaaataaaatattagaacttaagttttctcaccatccctgctggcctgaatgtctcctccaatatgtcctccatatagtaagaatgcaggctcacatcatcctcg

SEQ ID NO: 171 - DNA, 615 bp, Mus musculus
cggggtttctacttccgggtcaaagccatggcggtggcaaattcaagtccagtcaatccagtggtcttcttcgatgtcagcattggcggccaggaagttggtcgcatgaaaatcgagctctttgcagacgtggtgcctaagacggcagagaactttaggcaattctgcaccggagagttcagaaaagatggcgttccgataggatacaaaggaagcaccttccacagggtcataaaggatttcatgattcagggtggagattttgttaatggcgatggcactggagtcgccagtatttaccggggtccatttgcggatgaaaattttaaacttagacactctgctccaggcctgctttccatggcaaacagtggtcccagtacaaatggctgccagttctttatcacgtgttctaagtgtgattggctggatggaaagcatgtagtgtttggaaaaatcattgacggacttctagtgatgaggaagatcgagttccaggctcctttgggaaagagagttcaagcttggacccattcattaacctgcccagcacttactgggattttggctctgatcctgatgcccactgaataaaattccacttcttggcattgc

SEQ ID NO: 172 - DNA, 1307 bp, Mus musculus
  modified_base (8)..(8): a, c, g, t, unknown or other
ggagagcncgagccgtcatggctgcgccatgtaacctggatccaccgcggaggccacgtggcggtgcgggcccccgtcgagtcgggagtcaacatgctgcgggccgcgtggcgtgcgctgagctctgttcgtgcccaggcggtgacacgggccccagtccctgcgctgaggggcggaagtagcgccagtctgctctctgcgcgctgtggcctgcagcctccgagtctactgcgcgccgcgcgagcatacgccgccgtccagaaaccagtccaacccaagcaggacgatgaaccaccctcctctgcgttcatcaaagaatacaaggacatcatccccaacatagagaaggttgatgatgttgtgaaaagaatcttgtctttggaaatggccagcaggaaagagaagttaaaaatcaagcaagaacaattgatgaacaagattgtggaaaaccctgaggattccagaaccttggaagctcaaagttggtccaggggcccttggtagtgggggtgcacaggagtctgctagctggtacctagcctaggctcttgatgtggcttgggaaggggagaagcatgctgggactctggatcccaagtccagtgatgctagagttaacagctgagtcctgcccattgctctgtgtgagggcaaacaggtcatctgtcttctctggagtctctgcttccagagcagagtctaaagatggagctgtctggggacagggctgaagttctgtgttctactttgtggtgagattgagacgttagagaatgcatacatactttggaaacaaagattaggctactagcagcgagactcacgtctgtggaggctgtcacgcccacgagcagggaccatttccaggttcctgttttggtttccagctggagttggcagtagccctcattagatgtgagtgacagcctgcagcctgcctcttgagtagaaccaagaagttgcaggggagtgacttggtggcctatgcggtgtctgcagggtttcttcccagcctcgttcggcctgcattacagctggtattacctcctgtcttggagcctcagtcccttttttttacaactttgctaatgtgtgagtgttttgcctgcgggtatgtctgtacactatgcctagtgccagcagaagtcagaaaagggcttcggatcccgtgaactggaattacagacagttgtgagccaccatctgcttggactggaacttgggacctcctgaagagcatcttaattctgtggcatctctccagtcatataaatgagacgttttaattctgaaaccttaatggaaac

SEQ ID NO: 173 - DNA, 342 bp, Mus musculus
tttttttttttttttttgcccaggacctgcactttaatggctcattgctgttgaaagatgaacaaggtccaacgtcctggctcagtggctccacagggattctttgtgttccaaacacatccaaggttacagatgcctccgggtcctcaggctgtgcgtgtcacctcccacacacctcttcatcacactggggtggcttgctggagcaaacctctgcagagatacccaaggcctgcaggatgttctcctggggaacatagtcacccggggacttctggatgaagtgcaacagtaccttgtcgccacccttgctgaccaccagcagccctccactttgcagca

SEQ ID NO: 174 - DNA, 439 bp, Mus musculus
ctttggtggaggtgtctttctggtcccccgtctctctggggtttctacatgtcctttcgtagatgctgtgtacactctggatatggtatctgttttgaacagcaggcttgttggtccttgtcctctctcttgtgccaaccagggcagtggacctgtcttcagcacagaagtttcctgaacgtgtggctcttatcctacctgctgagtgctgtgctagggttgcggggttgcatcatcacagcctggttgatacatcactgtatcttcaccttgagtctgtatagtttcttttttcttgatccagttgtcagctgagttgtacagtgtatttccatctgcagagggacagctgcaccgatttcctggggctgtgcacattgactctcatggcacaccatccacagtatcctttgaattgtgttgatttagtaatcttgtc

SEQ ID NO: 175 - DNA, 3320 bp, Mus musculus
ggacccagcgggaacccaacccatcttcagccagagcctcagccctccgtagccgaggtgggaaccagacccgcctcgcctgcctctcacccactatcgccaagtgcaacagtccggctgcactgtccgtgagccagctcttatccgagatggcttcagtgactgatggtaagactggaatcaaagatgcctccgaccagaactttgactacatgttcaaactgctcatcattggcaacagcagcgtcgggaagacctccttccttttccgctatgctgatgacaccttcacccctgcctttgtcagcactgtgggtatcgacttcaaagtgaagacagtctaccgccatgagaagcgtgtgaagctgcagatatgggacacagctgggcaagagcggtaccggaccatcaccacagcctactaccgtggggccatgggcttcattctcatgtatgacatcaccaacgaggagtccttcaatgctgtccaggactgggctactcagattaagacctactcctgggacaacgcacaggtcattctcgtgggaaataagtgtgacatggaagaggaaagagtggtcccaactgagaagggccggctcctggcagaacagcttgggtttgacttctttgaagccagcgccaaggagaacatcagtgtgaggcaggccttcgagcggctggtggatgccatctgcgataagatgtctgactcgatggacacagacccctccgtgctaggcgcctccaagacgacgcggctctcagacaccccacctctgctgcagcagaactgctcttgttagacaaggcccgccctcctgtttccccatgtcgtgccctgtttctcctccgcttctctccattactgtccattccccaatcccaagcaagatgagttctttgccagcccctgcggttctctgcagatggccccagctacagatactaactgcaggttacggggtgggtgaacactccttttacaacagaaaactccctcttatgaagaaggttcaagatagagacttggaaagaatcttttctgcccttaaaatataataaaattcctttcatttaccaagcccctcctcctacgcacactcctcggggggctggccagtgtgtaaagtgaggcccacctgcacagctaatactattaaagaaaatgtctcaaagtacaacctgcttgtttcctatcaggctccctgtggggcaagcaaagctttgatttgtagagccctgagcctgttaccacggatgcccacagggccccgggcagttgctgtggtgacaggacagtgctaatccctggagagctcagattctagtgatgcagaagaagcaggggctgagtcagaaacacacttaaaagagaaggattatcttctgcaaaatgtcaaaggccccagccatctaaaagcacaatgaccagaaggagaaaaagcaacatagatggacacaggttcttacctttctagcctgctcttttgtctcacgatgtagccttaggctaggctcaaatgtgttatttaatttaggctgaacttgaacctaatcctcctgcctcagtttccccagtgctagaatgcagatgtgtaccatcacacccagtttctccagttggttcttgactgttgggataccatagactttgtcactgattctcaggccctcagagtctgcactctgaagctgatgagcttcctcctcctttcccagtttatctagtttgacaaatcagttccagactttctagttctggcacgtggcctgcatggctttgggactgacttgcccacggtgactggcaatgaagaacctataaatgcaatgaagaacctacaaacacaagtacaaaaaagttgggatatggtaggctgtgggctctgatggagactattactagcagcctggaaatgcagctctgaacaaggaggtgggtttattatacccgaatgaggagagaggttagctgatctaggtaaagggagctctatagggaagcaggctcaggctgtagtggccaggagcaggaagctgtggttggtattttctgcacactcttgtcaacatccttagtggaccaggggaaggcttggttatttccacaggcccaaggcattgtctttgacatagttgtgttagttcaacaatttacattcaccctggacttcactagctccccacaaccctctttcttttaaagcacaccttctatgagatgggagcggtggctcaggactgtaattccagcatattgaaggttgaggcagaaggatcaactgttccagggcagcctgggctgcagatgccggtcctttttttttttttttttttttttaagctagcatgtctttggggcaggcaccagagctgtccatagccaggatctgtctttgcttcaaactgaaaatggactcggggaaaccccccaccttctcaccccatttgcaccaattctgctgccagccatcttcccgtccctactcagaatctctttgatttaagcacaagaatcatggcctactctttcccaggggcagccctaactgcatatccatttgccattctgcagagggtcttcccccatcttgctcaccttttctaacctgtcaggcactcctccacagcccacctggaaagggggagtcaggcagaattagacaaggggacatagtcctgaacaaatgctaatatagcgactcaagggcatctcgttgtcctggaaaggcacacagctggtatcaggcccagtgatcaaatgaaagggccaaatagagtcagctctgtggacatgttgcagtctttgataaactgtaaaagagagattttgggtgtggaatttaggacgtctgccatttaatcagggtttttgttagatgttactcttacaagacacatagttcagcaatttccatgtattaactcatttatcttcgtaacactttagtcaacctcagttgaagatgaggaatcaaggctctggtttgcataaggtcaactaattagcaaatggtagagtggggatccaaaggcagggagtgcatccctaggtctgtgcttttacaacattctgcaccacagctcttttccaataagtgtgatcccgtcgcttggaatcctgcccaagctgtcaggtccaagtccacctgagaaaagatgtatgtctgtgatatggtaacaaattgctcaactactcggactaatctgcggtgatggatatccagagcgcagcagaattagtttctgaggcaaccagatcccatgggcttaagcaaaataaaatgcccattgctccttacgaccatgtgctg

SEQ ID NO: 176 - DNA, 319 bp, Mus musculus
taattgagctgttctcctagcctgttgatcaaaggattaagaacaccatgattcttagacatcataggaaaggtcccttttgggtcatcttggaggagattttctaaactagtagtaactaactgatcaagtaaataaaatgagctcacgtctttgtcttgactggtgtgggttaagacagtccttcatcttcttcttgtgtctaattgccctatcagtgtttgagtgcttactatgtgatgagctgcaaagatcaaccggggacagttctatttcatttatatgtactttgatgtgtctgactcgtgcgtgtcagaag

SEQ ID NO: 177 - DNA, 618 bp, Mus musculus
agttttcacaacttagacatttgagaaatagatatataggttcttggttacaaattggtttctcttctccaaaaataaactggtccttaccaaggtttacaattttccttaaactcagaaaaggttgcaaacaaaatccacttaggtagatttttccaagtaactttcccctttcaacagaaacgttgctatgaaatacagataaggactgagttgagaagctcagtggtacatagctcttgcctagcagtcataaagccttggctccaatccctagtttaggggaggggaatgaagcttagttacaaaatttctgctggaaatatggtttctgggggctggagagagggcccagcggtcatcagcaatgactgttcttccagaggtcctgagttcaattcccagcaactatgtggtggctcacaaccatctgcaatgggatctgatgccctcttctggtgtgtatgaagacaactacagtgtactcatatacataaaataaataaaatctttaaaaaaaaatatggtttccaaataaccattgacatttccagccaaaacatcctcccaaaaccatccagcagcctagacttttctttccattacattttaatttat

SEQ ID NO: 178 - DNA, 2690 bp, Mus musculus
tgcagcccccaggcctgcagttgcagtcagaggtactccctgacccaaaaaggcatggcaaggcctaggcatctccgtggcttgggaatgtgcattaccgcggtgctggcctccttcatcgctggctttactgtgggctggtttattaagcctctcaaagaaacaactacttctgctggttatcatcaaagtatacaacagaaactcctatctgaaatgaaagctgaaaacattagatcatttcttcgttcctttacaaaacttccccatctggcaggaacggaacaaaatttacttcttgccaagaaaatccaaacacagtggaagaaatttggattagattcagctaacctggttcattacgatgttctcttgtcttatccaaatgagaccaatgcaaactatgtatccattgtggatgagcatggagttgagatttttaaaacatcataccttgaaccaccaccagatggatatgagaatgttacaaacatcataccaccatacaatgcgttttcagccagcggcatgccggagggagagcttgtgtatgtcaactacgctcgtactgaggacttcttcaaactagaaagagaaatgaacatcaactgcactggcaagattgttatcgcaagatatgggaagatctttagaggaaacaaagtcaaaaatgccatgctagctggggccatgggaatcattctgtactctgatccagctgactactttgcccctgatgtgcagccatatcccaaaggatggaaccttcctggagctgcagctcagagaggaaatgtcttaaatctgaatggggcaggtgacccactcactccaggctatccagctaaagaatacaccttcagacttcctgttgaagaagcagtggggattccaaacatacctgtacatcctattggatataatgatgcagagagactattacgcaacttgggaggagctgctccaccagacaaaagctggaagggaagtctaaatgttagttacaatattgggcctggctttacaggaagtgaatattccaggaacattagaatgcatgttaataacattaacaaaatcacaagaatttacaatgtaattggaactatcagagggtctacagaacctgacaggtatgtcattctcggaggtcatcgtgactcctgggtgtttggagggattgaccctaccactgggacagcagttttgcaagagattgcgcgaagttttgggaaacttgtgaatggaggttggagacctaggagaactatcatttttgccagctgggatgcagaggagtttgggctgctggggtcaactgaatgggctgaagagaatgcaaagctcctacaggagagaagcattgcttacatcaactcagattctgctatagaaggtaattacactcttcgagttgattgtactcctcttctaaaccagctggtttacaaagtggcaagagagatctccagtcctgatgatggttttgaaagtaaatcactttatgaaagctggctggaaaaagacccttcacctgaaaataaagagtgtcctagaatcaataagcttggatctgggagtgattttgaggcttacttccaaagacttggaattgcttcaggcagagctcgctacactaagaacaagaaaacagataaatacagtagctatcctgtatatcataccatctatgagacgtttgaattagtacagaacttttatgaccccacatttaaaaagcaactgtctgtggctcagttacgaggagcattggtatatgagcttgcagactctgtggtcattcctttcaacattcaagactatgcaaaagccttgaaaaactatgcagcaagtattttcaacatatccaagaaacacgaccagcaattgagaaaccatgcagtgtcatttgatcccttattttctgctgtgaaaaacttttcggaggctgcttcagattttcacagaagacttacacaagttgatcttaataatcctattgcagtgagaattatgaatgaccagcagatgcttcttgaaagagcattcatagatcctcttggtttacctgggaggaagttctacaggcacatcatctttgctccaagcagccacaacaaatatgccggagaatcattccctgggatttatgatgccatgtttgatattgaaaataaggcagacccttccttggcctgggcagaagtgaagaaacatatttctattgcagcttttacaattcaggcagcagcggggacactgaccaatgtgttatagaaaggcttctgtcgagtagcttcatcaatggaaaaatattgcgtggtgtctgagagggaaactgatggggagtgggtcttgaccaaatggattccctgctaacagtgctgctgggaatctgaagaaaaaacggtgtcttttcctttgatgttttatgaaacctgacaatcctaaatctgtgattgtcatgacttgttttgtccttctaccttatttatctgtaaagagggctttttaactcttatatgcatatccagtggaagtgacagtgaaagaggaagcaaccccagtgctcacaggcagatgactggattcactgtagtatatacacatagcatgcatgcattcttatatcaagtccgcttggttctttacttcaccaaataattgaaaataaaaagttatttaatttt

SEQ ID NO: 179 - DNA, 1215 bp, Mus musculus
gcggggcgtagcgccgtgaggccgtgatgacgcacaggcgtacgctcggtggctcctcgggtaagatggcggctgcatctttgaaggagaggaattgaagagtgaggagaagggaaggaggaccagactggagagacgttccctgcggcgccaaaggacgccgcgctcgcggttaggagctcctcccggccccccacgtgacttagtaggaaaacatcaccatggctacagaaattggctctcctccacgatttttccatatgccgaggtttcaacatcaggctccccgacaattattttataagcgacctgattttgcacagcagcaagcaatgcagcagctcacctttgatggaaaacgaatgagaaaagctgtaaaccgaaaaaccatagactacaatccctctgtaattaagtatttggagaataggatatggcaaagagatcagagagatatgcgggcaattcagccggatgcaggttattataatgatctggtcccaccaataggaatgttgaataatcctatgaatgcagtaacaacaaaatttgttaggacatcaacaaacaaagttaaatgcccagtatttgttgtgaggtggaccccggaaggaagacgattggtcactggagcttctagtggggagttcaccttgtggaatgggctgactttcaactttgaaaccatattgcaggctcatgatagccctgtgagggccatgacttggtcacataatgacatgtggatgttgacagcagatcatggaggatatgtgaaatattggcaatccaacatgaacaacgtcaagatgttccaggcacataaggaggcgattagagaggccaggtttatacacaatataccattttctgtagtccctattgtcatggttaaattactctctaagtgtattctgggtgccaagatgcatgggctctctcagattctgggaaactttctgcaccttatgaacacaatatttctctttgttttcacacattcaccattttgctggcacctttctgaagtagttttgtcctggtatcagcctttgcaatatgttagagatgtattgtctgccacattttgcactggttttctctttcatttatggctaataatgtgtatacgttattcctttttattatctactgtgtaagacaagaatattccaaataaagaattcagtctttaattataaaaaaaaaaaaaaa

SEQ ID NO: 180 - DNA, 431 bp, Mus musculus
ctttacatgtactttcagacctctcttggaaatagttattttatacccatagaacgagaattattagaatgtgcttgaaggtaaaaacaaaaacaaacattgatatttttcttcagttccaataactctttagccatttattttataggaaatagttgtattgaaacctacaaagtgttattgaatgtgtttgtgaatgaatgctaaggctacctatttaaattatgatcaatttctcgtgaaatgaaactttcaaaatgtatgtggttgtttgctgtcagattctaagtatacattgtttcctcccaaaaagtttctatgactatagaataaaataatcttcaaatttcatctctgcttaattagtaaatttagtaataaggaatttgctcacataattccattcatttctgttactctaaatttcttga

SEQ ID NO: 181 - DNA, 2181 bp, Mus musculus
aagagttgagtggttaaaagcagttgttgctcctgcaggggatccagctttagtgttcagcaccagcatgatgcagcgtcacagccatccgtaattccagttccaggagacccagtactctgttctgacatctgtggacactaggcacacatgcggtccacagacacatgaagtaaagcactcatagacataaagtaaaatgtaaaggcttaggaaaggttacagaaacagttgatactttggatattttgaggccgtgtctcactgcattgccctgggtaacagcagactctcgcatctctgcttcgtcttacccagtactaaatataaatatagtgggtactggtaattgaaccagggtttcctggaagagcagccagtgttaagttgctaaggaactacctctactttgttgtaagactgaatgttgaaagaactcactatagagccttaatgctgtattcattatcctgtgtctatagagggaagccaaggcaggaactggtcgatgcagaggccatggagaaagtctgctttctggcttgtatcccacggcttgctcagcctgctttcttatacagctaaggaccacctgcccaggggcgataccaccccagcccaacacccacatccatcagtagtcaaggcgatgctggaaaaccttgtccacagagcagtgtggcctcgcccgtgccaagctgacataagagtcagcacagtgagatgtgacagtctcattatcagttgcatttccatgaacaagcaaacaaaaatgaacaatgataaaaaagtattcaaaaactgctcagaaataaactctagaggcagagagaggcaagaggattcctgcgtttgaggctagctcagtctgtaaagccctttagggaatttttaaaaaactcagtaagaagattaacctaattgaaaaatagccaaagttagccgcaaatgtatactcaggctgaaggagaagggttaccaaagcccggagtttgaggcccactggacaactacctgttggagaggagaccctgacagttaatgaactgctgtgagcatcaaacccacggtgagacctcacaccagcataggggaacagcgtctgagcaacagagaacaagacctggaaggctgggaagaagggaaatgccacacacgctgctaactcactgagcagcgcatctgctcataggaaaagctaagtgccggtctcgtagctaaccacagttccggtctaagagcaagaaacaaatactcagtgtaggcaagcacagcactgctcacaccagtgtcccccatcaggacctacaggtcagacttagcacatccgtgcaatgggtaattttcaagcactggctgcagagtctgaaacatgcacgtaagtgagaggagtcagaggagggtggcatagtgtatgattacgttttattaaaggtccaggtagtcaacagaaaagcaagatgggagcaatgggagcctggggaggcaaaggagtgggggaaaccaccaagcagagtattacaaactggtgtggtaggtgtgttgattgcgtggtaggttgcttttctgtggtgggcatgttactactgagctctcctcctagtccagcgtcttccctccccctttgctgacattctgtttgcctgcttgaggttactgtagtgatgacagacaggtgtgcctctcactgtgtaaactaggcttctgcctttcaagtgccaccatgtccaatccagttattccagccagccatggttacctaggcctttaatcccagtactcagcaggcagagagatgtgtggatctcagtgagttcaagtccagcctagtgcaaatagaactccaggctaacccaggctaacccaggctgcacgacaagaccaaagtttaatttaataagtgaaattcatctaaatttattaaaaaggatacgatcttgccttctacaaaagtagttttgtggctagaggtggagatgcatatcttttatcactaggctctagtgaggcagaggcagaggcaaaggcaggtagatctctgagtttgaggctggcctagtctaacaaagtgagttcaggacagccagggctctgttacacaaagaaatcccgtctcaggaaaaaaactaacgaaccaaccaaagagtagatttgtgagtttgaggacagagagacaccctg

SEQ ID NO: 182 - DNA, 814 bp, Mus musculus
gagagatgcagctcccgccagcccacgggtaggaggaccagaaccgtgacgatgcatcatcccaagccttgcaggttccaaaacgcctttctcctccgctgtatctcgtgacttggctgtcgccccacagtgtaaaagctgtcgtcgccgccgcctccactttacagacaggaaagctgaggtcctgagaagcgaggcaagtgcatcgactcaaggctacacgcatttaggagaccacagcacacaaatcagtgataatgacagaccctgtgttggcatcccagctggctaatggcactggggagatggatggactgtgctctgaactattgttgattcccccacctctctcaaaccatggaatcctgggccctgtccagaatacctgtgcttctggggagcttgcacctttgcctgctgacccaggctgcctgctggtagaggccacagctactgaagagggtccagggaacatggagatcattgtggaagcagtaactggaactctgtccccaggagctcctgaagagacctcaggtacaaacatagttgctaccaggccagtgggacaccgccttgagttttttcatctgtgctatttttggtccttgtctttgaatgtgatgagaacacaaggtagcatgctatttttacaccctgagatgctataatttggtttgcagttggtgcatgttgatggaaggctggcaaggtacatacagccttgtaacaaacttggcaaagtttatcccaaaagagttttgtgtctgctgggcagtaatccagaacaagaaacctttttgacacccctgcc

SEQ ID NO: 183 - DNA, 404 bp, Mus musculus
aattaaagacaagttctcactatgtagccttggttgacgtgggattcactatgtagatcagcacagttttgaactcaagagagatctgcctgcctctgattccccagtgctatgattataggcatgcaccatgccaagaattttccagaatgtattttatatgtttaaactgagaccttttacccatttaagcaactttaagaatttggtaaatattaagaacaagagattagttacaaagtacgtagtttgttattttagtactctacattcagcaaaagttcttgatttttctaatgtcacaggaagagcttactgagtactttctccaacacaccacaagtcatcctgcaaacggtaagcaattacacataattgtataaactcactcctaatgagtagca

SEQ ID NO: 184 - DNA, 1248 bp, Mus musculus
gagaggctgtcccatgaagcagtgcaaaggtggggtgaggcataggaaggaagcagagagtctaggacacatctcagccacatacaagtggccccgtggggaccggagcctgctggaggaggtggcatcaggctgagtggggctccctggacagagaggcacctgctcaccatgttgcctctccttgccctgcttctcctgatcgggccatcagtgtgcactacagcaggagacagagaggaactggcttttggtgcagaggcagagtcctgggtgaccgtgaacctgaagggaatccccgtccccagcattgaacttaagcttcaggagttgaagagaagcaggactcgccagttctatggtctgatggggaagcgggtgggagggtatcagctgggacgtatagtgcaggatctccttggcacgagaggtttgtccatagaagggacctgcagacaggcggcgagtcaacagagggcacgacccggagcagtgaccagagaaagcctccagagtcgagaggaagatgaggctcccctaaccaccagcaacgtgtagcactctgccacccatctctccccagaacatcacagctgaggagcctcagccaacagtcctgtcttttgtcctcaacttgggtatttcctgccaggccctcgtcacactctgcattttctcccaggactcactcttggcatctggtagcaacgacacacaaagcacggctgcctcctcacaagctggactgacccagctctcccttgtccctacagcaaagcttcacactctgtatcccaggcctagcacacagtagggctcaatcaacgacgagttagcagtaataggtagcttcctcagccatgcagggtagagggtgggatgtcagaaaagcagagaccaacattacacagcccaggtctaatgtctaatccttgggtgggaagagagcttggggcctggctaaaacggcaatagaaacaagaaaaagaccctggtggagaagacgctgcatgtattgtatttgggggcggggtcaggagccttcttccctttagattcctgatgttgctaccaacagacatctccctctgtgctgaggctatggctcagtgggctaaggcgattgtggccaagcctgacaacttgagttcaatccccaggacccacaaagtggaagaaaaaaattgtccttttacctctgcatgtgtcatggcatatgttacacaaaataaaaagacagtttggaaa

SEQ ID NO: 185 - DNA, 193 bp, Mus musculus
tttttttttttttttttttttttaaagcagagagttaaacgtttatttaaaatattttaaatataaatttaagttacaggggttaagaggggctcagggaaagagtaaaacaccccaaaaagctgggctgggggcttttccaaggacgaaagttctttttttttttttttaaagatttatttatttattatat

SEQ ID NO: 186 - DNA, 904 bp, Mus musculus
ggcacgaggagcagactgcctacctggaggacaggcccatgtccttgctgcagtgtgccatggaggagaactgcctctccgcctccgctgtgcacaccgaccccaccagaggccaccggcgccttttacgcttctcctcccagatccacaacaatggccagtctgatttccgccccaagaacggccgccatgcgtggatttggcacgactgccacaggcactaccacagcatggaagtcttcacttactatgacctgctgagcctcaacggcaccaaggtggctgagggccacaaggccagcttctgcctggaggacactgagtgtgagggagacattcagaagagttacgagtgtgccaactttggagaacaaggcatcaccatgggctgctgggacatgtaccgtcatgacattgactgccagtggatagacatcaccgatgtgccccctggagactacctgttccaggttgtcattaaccccaactatgaagtgccagaatcagatttctctaacaacatcatgaagtgcaggagccgctatgatggctaccgcatctggatgtacaactgtcacgtaggtggagccttcagtgaggagacagaacagaagttcgaacacttcagtggacttctaaataaccagctctctgtacagtaaagaagatcctgggccaggcatgatggctcatgcctgtaatccctgcactcatgctgaggcaggaggattgccacaagatttccactctggacattaaaccaagcttcagtttcaaaagaaatgaatgaaaggaaggaaggaaggaaggaaggaaggaaggaaggaaggaaggaaggaaggaaggaagaaagaaagaaagaaagaaagaaagaaagaaaaaaaaaaaaaaaaaaaaaaaaaaa

SEQ ID NO: 187 - DNA, 1560 bp, Mus musculus
tacgaccttgcctgtgtctgctctgagttcttccgcgcgccctcgcccgacccgcgacagcgatgctagcgctgcgttgcggcccccgcctgctcggtctgctctccggcccgcgctccgcgccgctgctcctctccgcgacccgtacctgcagcgacggcggagcccgcggcgcgaactcttcctccgggaacccgctcgtgtacttggacgtgggcgccgatggacagccgctcggccgcgtggtgctggagttaaaggcagatgtcgtgccaaagactgcagagaacttcagagccctatgcactggtgagaagggctttggctacaaaggctccaccttccacagggtgatcccagccttcatgtgccaggctggcgacttcaccaaccacaatggcacaggagggaggtccatctacggaagccgctttcccgacgagaacttcacactgaagcatgtggggccaggtgtcctgtccatggcgaacgcaggccccaacaccaatggctctcagttctttatctgcacgataaagacagactggctagatggcaagcatgtcgtgttcggccatgtcaaagagggcatggatgttgtgaagaaaatagaatctttcggctcaaaaagtgggaagacgtctaagaagattgtcatcacagactgtggccagttgagctaactcacagccaaggtgctaggacagcagcaggcatccatgtcttgattcacccaggttctccaaagaacagtttgcacccacttctattgagtctgaggaaggccactcaggcatggtcctcccagaccaggctgctctccactgtccatcctgcctcagatcccgtttctgggcatcagtatggccatcgggccatgtaccctcagccgatgtccccgtgattgccatgtgcgtgtgccttggacattggcaatgctgaccagttagtcagggaaggctcctgactcttttccttgatcagtggggatagcagttgctatttaatgttgtcttcctccttgcaataatttaacatagaattcaagatctcatcgaaacaaagctgtgacactcatggcactgtccgtgtgtgacctgtgttgctgtgacactcacggcactgtccatgtgtgacctgagttggcacaagccacagacacccccaacccccccacctcccagcctggcttctgagacatcactcagggctcttgtgaaagtcccagcgtcaatgccttccctcctggtcactgtgaatcctgctggctgctgctgtgatttttgaaagcctgtgaaatagaagcagcaggacctgggaacagacctgtgagcccggtctttctgctcaatgtgaattcccgtggtgaaaacttacagacactgcctgacctcatgctgttctcaagagggaagtgtcttctggcaggctttgctttttctgtatgttgaataaatccaatctatcaataatatatatgtaaaagatttctgggacagtcctgtgtgttcatctcaaatgtgataaataaatcctattttctataaaaaaaaaaaaaaa

SEQ ID NO: 188 - DNA, 1266 bp, Mus musculus
gagacccaagtgttaacacaaagggaaggcaggcgcatcctgctcagcgcatttcggccacagataatatggcccgtgtgctggcccagcccacactctgacctccaggcgccaggtcccctacctcagtcactcctgcccagaccagctgcggacatgcttagcggatccgggtcccagggaaggcgctgcctggccacactctctcagtgagttctgccctttgcctctttgatttctcttttctttctttctctctctttttttttcctctccaacaaaagaattttttttaattctgggagtggggaaaagaaagagcaaggagggagagagagagcgagaggaaggcaggagtgtgtaaaaactttgtagtttcagctgcgggtttggtctggagtcactggctttctggttttcttcatttccatcttcctggtgccttagcaacaggggttttacctaggacctgggtttctttcttccaaatgcaggccacagggtattgtgctgctaaagatctgctgttaatttagacccgagctctctgcctcaaagtcatcctttgcagggcgcagagatttcactaagccacagttgcccaatccgtaaagtaaacagcccagagccctcagcatactgaccatctgcctgggccataacaagcctcaaagcatatgctattgatcaggggggctgttcagataacacgagggttctgcggctttagaaacgtggaattctggaatgtgaaagtgagcggggcctctgggaccctttgggggtgatgctgtctttctacagacacagagcccagagggataactaagcttaccaaagccagacaacagcccgcaaggatggggctcctctgttccctgagcagaggaggcctttttttcgcagtagtgtctgtgaggtttgaaaaccttaatgcgtcctgggcaaaggtagtgtggaggagtgaggggcaccagatggccttttggagagtcgttcccatttctgagagttttggctttcattcaggatcacggtcactgggtccagttgccccagagcttgtgcaaccgttggtcaaataagcagaggagcttggtggggtcctagaaaatgagagaccttcacacccacagtgtttgcagcggtttttggttaaccaggttttgttgttgttgttttggttttttgaagttggtcactcaaatgggaaagttcagggggacctgggagatggtctatacaattcagtgcttgttaaacttt

SEQ ID NO: 189 - DNA, 673 bp, Mus musculus
  modified_base (16)..(16): a, c, g, t, unknown or other
  modified_base (31)..(31): a, c, g, t, unknown or other
ctttatgtatgcgtcntgatttgaagggagnaggttcgcaaagaaataaagttggtgacagatgccacgaaggggtaccctccaaaccctcacagcaagaaagagaaatatctgaacgatttccagatgttgttaaccagagtctagacagtgacgacgacctaatgacattatcacctctagaaagggctgctgcttagcaatcgatttatagatatcccacggtggatgctccattttcctggtttacgacccgtactttctgaaggtcattgctaagtcaatggctctcttgtggaagatgatcccagcatttattatgcactatgtttacttcttacttggggaacctaattatccagagaataaaattcgccaggtagtttgggttgtttttctggtattgaaatttgaagttaaatcagaggatagaaagcttcctggtaattcagcactggattctgctaactctatgggaagagcaaagcccaacttacatgattcgtccgagcatccccatcccgagcagttcagttcggggagggagatggggttggaagtgcagacagggtcctttcatccgtgtgtgttccctttaacggttcatcgtccataacaaagaacaagtgtgctgtactcttaaaagagatggaaataaaaagacctcagagcc

SEQ ID NO: 190 - DNA, 678 bp, Mus musculus
gggtggtggtctcgtggaacggagatataagtaatgaaccaccatgaaggtgtgagaaccagaacctagtcctgcaagaaccaaaaatgttcccaatgtgtgagccatccatctctccagctcctccaccctgtctctgaggcagggtcttctggtttgtctcttcattctccaggtctgcacactttaactacttctgttttggcctcctgtctcactaggaaccctgggatgcaggtgtgtagcacactgtgggctctgagaattgaactcaggtcgtcaggcttgcagagcaagggcttttacccactgaacatctttttaggccctccttaaattttaagaaaaaaatctctccctgaacgtggagctcactgcttcagggccacctatctaccccagcagcaccaagatgcacacatgtgttgcactgcaccagcttttattatatgccgtcctcatgcctgcatgtcaggcactttacccatggagctgtttccctagctcctgaaaagattttctgaagcactgttctataattatattttaatgtgtttttattttgagtaatgtggaaagctgaccttatgttacctatctggatttaccacccagaatggaaaatttctttgtcaattgcctaaaaaataatagaaataaaaccctataatatgttcg

SEQ ID NO: 191 - DNA, 8671 bp, Mus musculus
gagttcctgcgcgtggcgtcctcgcagcgagacgccgctggagtcgctcactcggagagattccttgaaccatctgcagtcatattattctctgaagagggtgcacttgattgccaatttgctctcagtatgacacctgtcaatgtagctctaatccgtgataccaagtggctgactttagaagtctgtagagaatttcagagaggaacttgctctcgagctgatgcagagtgcaggtttgcccatccgccaagagtttgccatgtggaaaatggccgagtggtggcctgttttgattcactaaagggtcggtgcactcgtgagaactgcaagtacctccaccctccaccgcacttaaagtcgcagctagaagttaatgggagaaacaatctgattcaacagaagactgccgcagccatgttcgcccagcacatgcaactcatgctgcagaacgctcagatgtcatctcttgcgtcttttcctatgaatccatcacttgcagctaatcctgccatggctttcaatccttacatgactcatcctggcatgggcctggttcctgctgagcttttaccaaatggtccggttctgatttctggaaaccctcctcttgcactgccaggagttcctggtccaaagccaattcgtacagatagactggaggtttgccgtgaatttcagcgtggaaattgtacccgtggggagagcgagtgccgctatgctcaccctacggatgtttccatgattgaagtcactgataattctgtgacaatctgcatggattacattaaaggccgatgctcccgggagaaatgcaagtactttcatcctcctccccacttgcaggccaaactcagggcagctcatcaccagatgaaccattctgctgccaatgcaatggccctgccgcatggtgcacttcaactgataccaaagaggtcagcccttgacaaggccaatggtgccactccagtctttaaccccagtgttttccactgccaacaggctctggctaacatgcagattcctcagcaggcttttatcccaacagtgcccatgatgcacggtgctacaccttccactgtgtctacagcaacaccacctgccagcaacgttccctacgttccaacaactacaggcaaccagttgaaatattgagcagcagagttacagagtatcagaatctctcaacaagaaactccgtgtggcctttctatatgtattctcgtatgtcttcttgtaccaacacgacaataagcatggtgcagtcaatatactaaagcgcatatacctgttgacaaattcaaattttaaaaatctgtggagatgttaaagcaaatagaaaattaaccagtatgtgttaccttatacggattcattgtatatgaattagcatacaatatacaaccatacaggtttgtcatgtatatgaattatcagatccatattacatgaattttccatatgatatgaattaccatattgaatataactgtaaaatgttgtgactgctttccagtaatggtttataataaatgaacttccacagtgtactgtaggcttactgtatactcttggtggataaattctgttttggaagtgttaccttactgttttgtttacaagatagtctataggattgatgtagaatgtaactgatatttcccacaccattttcctccattggtatattgtattaaattgggttctgcttagctctttcatgctatagtgttttcttgtttatacgtgatatttgatttcaattaaagcatcataagtggtgaacagaactatatgtgactgaaaaatgtgacaggttcatggtaatatgccctctttaaaacatttctgcaagtttccggaggcctcacttctgagtgtgcacaaaatctcttcatatatagaattttacctgtagatctgaccttgcatagtcaataatatactaaatttttaaaagagaaaaaaacttccctacatgtgataggaaagttcaaatgttaacctcaaaccattcctcttaaataatttgagaatcaagtgttcacattccaataaatttcttagcatgtataaaaattacggagagtagccattacatttattgtgttacaggaatcctatctctcagcttgagtgtctaaatttgagccatttgtcatcttcagctgagaaactggtactaactactttaaaggtatactaatcacaggctgaaaatcaagcagagagatgtgggcgtggagacagtttttatgtactggaagaaagtgtgtaaaccctttgcattgtaaccttttgcacaaatgctgttttccaaatgcaaatggctcgtgctcttttgactattctttgaataataagtaagatgcagtctggcaaaagtcaggccaggtgaaagaaaattgtttccaaatgaggccttgcctccccaaatggaccatcttttctattgatcacagaaggaggctgagtacaggtttagagaaatggcaggaatgggggcagggagagatttaaaatgactgggaatgtgcaaaagaactagaaaaggtttccgaagttgtctttcggtttagtttaatttagttgagtttccagtttttgtaaaggcagcagtgaattagcaagcatttgtgctactgtatggacaagggtttctctgccaaaactttaacatcagagggttggctgtgggggggggagatgatgatttgttcagttttgtctcagaaccaaacctatttttgtcacatctgaacttacttgcctttgtgtgtgtttcaaaattagttttaacatcctttggttaatagagaatagcaatagccccatggaggtgtgatatgaattcttcttaactaatacttaggaaataagctacaaatatggtaatccatctatttctgtgacatatagtgtacttcttctacttagcactactattgttataagagggaggaaatgtattttccaaaagcctaagtaaattgaatattttatactcagtatatattctcccaccagaaagcataaaatcaaatttttgtacatataacagttgtttttcttcatgaaaatcgggaggaaagagagactgtccaggatatcataagacaggtagttggattgatttgccaaacagtgacattggcaaagactttattgccttttctacggttggtaaaacagagagccagactgtgtgacttgcctcaggctggctgcctagccattgtgggaaccaattgctctccctctttacatctttctttggaacatttgagactcctatgcaaagcagatcagatcggctcagcattttaaaaaagcaaaactacctctggtggatggtatctcattgatcttaattatccaggtgaatcctggttaccagtgattgctaaatactcttgtttttatattggacctccgccctttgttgactattgcctggagctaagagattgagagttgtctgtccttttacctgtgggctctttgaaccactatatttctgttttctaacatcgcaattccaggaagaatctacctgagctagtctagatgtagttattaatggatatggaaatgttttgtgcaaaataaactttttgtagtttgacactttggtgcaacatactatctggtttaacttcttaaaattttgatcaagatatatgtagatgataaacttagagtagagttgttctcttgttgctctaagcactggaagatattaatgttgacttatatttaggaggagattcagtggggaacattcagggtagttgtctttttggtgcgatgagtttaatataagtgttagcattttaaaagttgcaatgtacatgaagcttaagaaagcaagctcaaaactcgaacattttgatcaaatttgatggagttttgagggaaatgaaactttaagctggcactctagttgtgcagtgactaatgatcttattgaagaaaagacaagtcatttgactataaattgagttaaccagaccagtcacaaccaatcagtgactctaaatgaaaatttacccaagtatttgtatataaaccaaattctaatcagatgtgatttctagttagcattttttagtttttgtgttttgccatggcctctatttttatttctccaaaattattggctttgtccatctcagccttttgccaaaatttgcaagaacactgaaacttggataaaatgtgtcaaacctacaaataagcaatctaaatttgtcatttaagaagagcttagtttcagtttttgcaaaaaaccatgagaccgtaatgagtaggaactagaatgaaattgaatggattcgtacaactgctatttaaatacagtgtttacttttgaaattggagcatgaatccacacctagctattgcttttcatttgacttttctagataaattttcagttttcatctattcatgaaagcagtctgcttgctattccatcagtcttgctctgccgttcatctctgagcatcctaaaacactgtgatcttgccataagtgttgtcctatgccactcgactgtgtccactcatgggaccctcaactctcctgctctcaactctcagcaggaaccaaattaacttagtattttgtgcttgggttcactttaacagcataaggagtgagacagtgctgtttggaggacgaacagcagctacagtacattgtaggaagggaaagaggcagctgaggcgctcatgagctcctcggaatgccaggtgattctcttccttgtctttggtgagtgttggtaaggaggcccctagacaaaatgcagccaaggttgtcgaagatctggcggtctgtgggataggctgtggcatgcagaaggcttactaacaaagttctcgctccacctttaaaaaaaaaaaagaaagctcttctacatttcactgaaatggaaatgagtaaaattggggggaggggtgtctgattcggtttgattcatttgatggatttgattccaagttttgatttgtagatttaataagatagtggcctaattttaccggagtctgttagagatagtagaataaaatagcaaataagagagtttagcttttttttttgaaagtttagtagatagtctaatcaaactataaactgtaaatgtgattataaatacaggctctgagtaccaagttactaattggtgccatgttttcgtttttcttattgttagtttttaaagttttaattgtactacatttttatatctaagtatccaatgagtttaattttgaaggagagttggagaaggtttaaggttttaccacttctattcagaccatctctgtaggctctaaactgagaccatagcgtaattcagcatagatacagtccagaactaccctctacaatccacagttcaagaacaaatttagcgttgtacacaaatgatagatgtcagctaaatatatttagttgttgccttggcaacaaaactacaacatggctacctttagacatttatgcatgtaaaacttttatgtgtaagctatatgtggttcatgacagtgcaaacatattgaagatacagctcaaaactcagaaaactgatgatgtttttgaagccctgtgttccatatatgaaagctgaatttgtgtcctcatgttaacatttgattcgaaaaagaagtttataacacatggattctagaattgggctttatcgtttaaagaattggttgggttgatagggttattctacagtagaacaagctcgacattgatattgcctggcctttttttcacaactttattcaaaactacctattcgtgtagtatctgtagttataaaaagattatattttctggctttattcacaaaaactatatgtgaggattaaagcataagtaaacatgttgagattaacccatggttgtgaagccacacataaagatactatagaagagcccctgaacagtgtttaagagacatatgctgcagttccccgactgtcccagttagggtgcgaatgtgtgagacccatctttttttttttttttttttttttttgcacttatgtacatagtccatgaaagcaatccttggagcttttgacaatgtaagaagtctgtggtaatagaggagcattagtgagagtgctgtttgaggctctaagaattagtggaagcatagtgtagcagtactgttgagggggcttgctagctggctacagcccaccagaagctcagactgctaacacatgccagatccccctaacagcactgagtgagaatacaaagcacttcttttcgtaaggctactagcaaaagttatttgctttttgaattaactcccactgtaaaaacacacacacacgcacacacacacacacacacacacacacacacacacacacacgaatgcttatactacataatggataaggttcccagtagagattttcttttttccaattatagaaagaagagaaactactctgtacattacaagctagttagttactctcaaatctaattaaaacagatctcatccttcgtagtttaaaattatatcagttaatgtggatttaagtgaaaaattgttaatgttttaactaaacagaagtgaagcagcccaaatcttatagaagatggaccctggaaaatgatgtcaatttaacctactctgccagttctcactccacatttgcagatagccaaggagccttcttgttgttctccaaggcactgaggcttagcaaagttggaagtttgaaaggttaagggacagatcatctctggcactttgaatccttcccatcttaagacagatgtctttcacactaaggaccccatcctaggctaagggtagttgtgaaatgttgcttttcatacactgctaactctcttggaggcatataactagatctgcacccataggtcattagtacagcacttgcctggatgaacaaggccctgggttccatccccaggactgcaaaaggaaaaaagggggaagaaagagagagaaagatggaaaacagaccaaagctacaaacaacccaagccttacatgtatcccgtagctcagggccagttggctaaaaattatttaattttcccttcagcttctgatcactaagtcagtttgttgtatggctatacaacaaacgccctgacaatctgagcagctgtttttagccaatagaagatggaagcatatattcattttatagttaagaatgcccacttcagccttactacccccataatttcactacttcaccagcatccttacgtggacgtttccttgtgaatctctaagtcataagaatgcatcttcataaggacaatagaaagatgaaattttgtgtatggtgctgagaatacagcccagggctttgtgtgctatgcaaatgctctaacaccctggttagccagtgataagattttaagtccagagctatcaaccataaattagtagggatgagccttgaagcatcacaaaagatagccaatgaatttataacatgtacatgcccaccaccacttggtcccatgctgaagcttaaacatagtgactgtatttcaatcattcaaacaaaggagaggattaagtataacgagtgcatgtgattcaagctaaaagataaattgggatttaagtttgacaaacttagcatttctagcccttctgccttgcctataagtgaattacccactggaattgaaaatctagattatcccaaagaaaatgtatgtgtatagagaacccttcctcaatcataaaagatgaaaagtgctttggtctgaaataagttgccactccgtatagatacttcaagaatcctcactagccctcttttacattgtgttactttaaaaaaaaatacctctgtagcaagacctagaagaattaagtgagctttttctcccacacatgtacaaccttaagactctgccatagaactgcatggttgcaaagctttatttctgtatacagatgctatctgttaatgatggaaaccaaattgttgtcttgccgtgtcttttgtgtctagcagttgagtggatgatatgaccatcatttcattagatgctggggataacctcaaaataagtttcttattattatcataactgttagttcggttacaaaatgagccatttgctcccaaattacactaattaaaatgaggtccattttttagaaaatgaggtctcactcactatgttgtgtaaactagtccaaattccatggccttgaatgatttgattattcctcggtgtgacttctttcgcttgaccaggatgagctaggttattcctttgtgtaattttaaagaataacttatagctccagctaacaatgatctggactgtagggagaggaggcatttgtcttgggcaggggatggcaatataagaatttctttgccctatgccacaattaaaaactgaaataagaaccaaaatattttacaagtaaaaactgttcacataatattttgttcccaaatgtggtaattcattccctcaactgcagatgtttggactttttcaagttatagtgttgtatgcctgtttgtgtttagaagtgttcattatatagctcattttagtatgctactttttatgtttcctttttttattctttcaataaagtttgcaaattccttggtta

SEQ ID NO: 192 - DNA, 672 bp, Mus musculus
ctgtaacaaggatccctttattaaacacttcagacacagcatgcctgtgtgagctgacagcagcaggaagaggaggctgcccaacagaagccattgaggtgcagcctgtgagaaacagctctgaatttataccagcaggagcccctctccagcagcaatagtgcctagggcagggcaatttaaggtattcattcttccatcaccactgggggtgaacctacactgctggaacccctgtttaggtgtcccctcttacagagcactgtggaggggaatcagaacttcatttgaaaacaccagtcctaacattctacccaaggggaccccgtgccatagtccttaatccagtggtggcttcctcaagcctgaaagatgctgttctctgtgattcttgggacttggcagactgcgtcctgggagctcctgtagacacaaggcaaacttgctgtgaagagtctgaactctcagccaatggaaccatgaaaggtgatgggggaaaggcagcaaaccatagaagcctgagaccaattcacatcctatctttagacctcggggcacactctagctgtggggtgctgagtgcaggctgatcatgttgatattctgaatatgctgcaaagtaactgtgtgtgtgtgtgtgtgtgtgtgtgtgtgtgtgtgtgtgtgtgtgtg

SEQ ID NO: 193 - DNA, 685 bp, Mus musculus
  modified_base (174)..(174): a, c, g, t, unknown or other
cgagtgtgaactatttcatgcttttcctgggtctcaggcctgtacacagtcatttctatcagaaagctgaggttctgtgaagattgcgtaccccacaaggagcacttcttcgagtttctctctttaagcattctatctttcttgctgctggcgtagtttctcagttttctgctntttgttgcattactaaaccaaattaaaatgttaagttgtgtgtattgtgttcctctcaggcatatctccaggacccagcattatgtgaagttcgtcatagatactcgatgattctagacttggatgtcttcacctcatctctccattgttcttacatgactgacttctttaccacataatcttggctttgggtgtatgaaaacattttgaaagaccacttattttacctctccaaaataacagatttaaaatcttagcacaagacttttgatttaccagagcctatatagatatatatatatatatatgtatatacatgtgtatgtatagacacagacacagtacaccagaacgtgaagccactgtacttcaagttagaaggtctgaaggacacctcagttctgtgctgttggattatgtgacactttctgctgccttctctcctgaggtggcaaccattgctgtcctcagtgtgccaggctcctgcacctgctgtctaagagactaaagt

SEQ ID NO: 194 - DNA, 598 bp, Mus musculus
ttctgaactatgcccttgaagcaaaccacgtccaaggagtcctgaatggagtggctccagcatctacaactaccaatgctgagtttgcccaggccttgggtgctgccctgggccgcccagccttcatacctgtccccagcactgtggtacgagcggtctttggagaacgtgccatcatgctgttggaagggcaaaaagtggtccctcggcggacactggctactggctaccagtactccttcccagagctgagggctgccttgaaggatgttgtagcctgagcagagaaggagccccaaggcagaagctggggcctgctcccgcactttgagaagtgggtcaggtgatgatccctgcacttgattgagatcagaatccatcagggtcttagactctgccccccctcaccccactctcttcccatgttcgttgatccacccctatctgagaaactccagcctcaagaatataatctcattctaaccttcacctcttcaacttcttctgtggcttctgtgttacattgttgccctggttctcatatatgctgtgtagacaatgttctacagttatggcaataaagatagattacatcgcc

SEQ ID NO: 195 - DNA, 305 bp, Mus musculus
  modified_base (44)..(44): a, c, g, t, unknown or other
tgtttccttttccttatgacaggtcatagttctttcagaaattnatccattaagatctccagttccttgcccatctctatgtaacttcccccaccccccatcccccatccacctgagtccaattttctctgggctctattctccacccctcagtagatctgttcagtcccacctctgggtgggagtgatcagggggctcagccccaggatttccaaccctggaaggcagctccaatttagcgagagagttgggttttggctacgaacctggcagctcaggagtggcccccccactcacccccccc

SEQ ID NO: 196 - DNA, 701 bp, Mus musculus
cccccccccgagatcaacggcctgtcccaggcatccgcatgtaccagatccagtacaccaggtcggccgacgacatccttgtttacaggatgatcccagcggacagtcgctccttcctgctgaccgatctggcgtcaggccgtacctatgatctatgtgtgctcgcagtctatgaggacagcgccaccgggctaacggccacgcggccagtgggctgcgctcggttctccacggagcccgcacttcggccttgtgatgcaccgcacgcacccttcctgggcggcaccatgatcatagcgctgggaggtgtcatcgtcgcttctgttctggtcttcatcttcgtgctgcttctacgttacaaggtgcacggaggccagccgcccggcaaggccaaggctacggcacctgtcagcagcgtttgctcccagaccaacggagcgctcgggcccgtgcccagtgcgcctgcccctgagcctgctgcacccagggcccatactgtggtccaattggactgtgagccctgggggcccagtcacgaacctgcaggaccctagccaagggcccacctctatggttcctctggtcccagggacacccctcgggacctggcctcagactcaccaaattgctcacggtttttaaaactctgatggggagggtgtcgggggcaccggggcacaacaagaaagtcctatttttct

SEQ ID NO: 197 - DNA, 693 bp, Mus musculus
acttaggtctcccagacattgtccaaccaagaaacaaggggcactaatatggagtgggttgcccattggcccaccctatcggcgtcggcgtttggggggtgcacctgatacagcgtgctctgctggtcttcctggatgagggggagagagagctgaggcctcaggacattcaggctcgaggctgaatgctgaggatgtgacatgaatcctgagccatcaaggtgtctgagcatctggctggttcctaactgttcccagctctagcttcagaggacagtgtgttttcttgtgtgtgtgtgtgtgtgtgtgtgtgtgtgtgtgtgtgtgtgtgtgtgtgtgtatgtgtgtatgtgtgtgtgcgtgcgcgcgtgtgtgtgcgtgtatgtgtgtgtttttaaatatgtgacagtatttcttaatcaagctgagtgaacattgggatacatggtgcttctggaagagtagtgagctccccatcacgggaggaaaacaagccaaggagcagaagctattctggagcaccacctttaatcccagcattcaggaggcaatagcagacagagctctgtgagttcaaggacagcctggtttatagaaatgagttccagtgcagccaggggatatacagagaaaccatgtcccccaaaacaaaccaaaaaacaacaacaaagccaagatggtactctggaatgc

SEQ ID NO: 198 - DNA, 2317 bp, Mus musculus
tgcgagcaagtttcccgccttcgacattttccagaactggaaggtcctcctgtctgacagttgtttcttttggtttttggtaaggtccaagaaggtgaatgaatataaagaaaatgaacatattgcttatacttctctgagaccgatacagattacaactttaaggaaaacagctaaggtttatctttacccgttttcactcagcaattccaagctaggcctacttaagttgtccaaatccccggttgtaaataattctagcaaatcagtggtccataagaagaaagatcggaagaagactcgtagaaaggttttaacttcaaaaatgaaggccttatcttccaaggcagattcccttctgctgaaatcatccgtggatgcttatactgaaagtaccaggctgggacccaagaggacctcggattcagcgactctcagtgtggacgcggaaagcagcgacgaagacagtgcaccaggcctggatgatttttcaggattgtcaccttatgaaaggaagagactgaggaacatcagagaaaatgcaaacttttttgcttcccttcagttagctgagacacttgtgagcctgctggtgggtgttgcatgctgcccctccctgaactcggctgcacggctccgtgggatgataaagaagcgcgagtcacctgagtcaaagagaaagaggcctaagaagaaagaaaatgaaattggatgtcgaaggtccatgcggttgttgaaagtagaccctttgggagtttcattaccagcatctccaacacagccaacattagtagaagaagaagaaaatcctttgttacctcctggacccttagaaatgattcctgaaaaccaagatgacagcagtgaactgttgaaagcatctttgaagacatgggcagagatgagccagacaagtaatgagaagaccaagaaggggctgtctagtattaaaagctataaagccaatttaagtggcatggtcatcagtgaggctactgttcgtaaggtgaccaaaggagcaatctcctccgtggccctccacccatcagaagtgagaaccttggtagcagctggggccaagtatggacaaattggactttgggatttgacccagcagagtgaagatgcgatgtacgttttctatgctcacagtcggtatgttagctgcctctccttctcacccaccaacccagcccatctactgtccctgagctatgacggcacactgcgatgtggtgatttttccagcgctgtgtttgaggaggtagggtctgaccaagaagcctaggctgaccttgaactgattggtgatcctccaacctctgccccagatgtctgcgactatagtatgggcatgtgccaccatatccttgttacataaccattttattgtaagagtgctgttgtgtttctaggcttaagctttgtgcatattcattttgtgctagagattgcatctagagcgaagagtatgttagataagagacatactactgttgagccaaacctcattttttaaagtctcatacattcttgctggcctcaacctccttacatagtcacgaataaccttgaacttttgagccccttgcctccatttcccaaatgctctgaatctataggtatgcaccatggtgactggcttatgctgtcctgaggatcaaactcagggatttatgcatcctggtaaatgctctgccaactgagggacactcccacctctgccctcccagcacagctttaacacacatcctgaagagattacccacactaagaagatgaagcagatgctgtctgagactatttggagcttgctcaatgtgcatgcattcctgtgcttgatttccaacatggcagaaaaggaacagaagaaagaagagttgaaggaatcttttaggcttctttttgagacaggttctttctctgtagtcctgactctcctggaatttactgtgtcacctgtctctgcctccctgagtgctggtattcaaaccttgcattaactatttttaaaagatagtttacttgtaaaagtgtttgctgtataaccatgaagacctgagttcaatccctaggacccacatgaaaaattggtatgcagagggtggagagatggctcaatggtcggtggctgcccttccagaggacccaggtttaggttgttgtacctacatggtggctcacaaacatcttacctccacttctaggagatcgggtaccatcttctggcaagcttgggtaccaggcttgcatgtggtcttcataagtccatccaagaacaatacccgtatgcagaaaactaataaagcttttaatc

SEQ ID NO: 199 - DNA, 331 bp, Mus musculus
cgcccacccccctcagaacttgtgagcaatgatcagagtgacctctagttctcagcagccatgtcagcaccagttagcctagttattactcatggcctcaagtgtttcaacctacatttttacaatgaaaatatcagctcttataaccagtgataaattttaaattgtaattattatatgggctaggaacatggttcagaagtacagcattttccacacaagcctaacaacctaagctcagatccccagaatcaaataaaagttaggtgcagtagtgatagatagtgccagtaatcccagggtgcccatcaggaggttggaggaagaagct

SEQ ID NO: 200 - DNA, 705 bp, Mus musculus
ggcttagaatgaaccattaagccaaaacatggaattgaaggggtgaaatggggcaaaagaaaaattggtattggaaagttgaaggaatggttagggtaaaagcccaatgttccttgctcgatgaagtttgagtaaaggaaccaatgcaggtgaaataaaaagaggaaaaagggatgggtcaccaaagtaggcagactgctagagtgaaagaatgatgagtattcataggtaacaaggagctatggtatcaagagttacaatcacaagaccttgggtaatgctaggcaattggtgagagccaagtagagaaccccaccatgaacataggtatatgagatggaaacaacctggactctggactcagtgttcaattaaggtcagctctgttctccatgtccttgtgggttatacttagcatgcctcaagatatcatatatttttttaaaaaagtagctcaggccaatgtatcagctcctctgctaatgtttttattagtttaagccatgttctcagtgtccaagataagtagatatcttaactatgagaacacaaggcaggcaaaatggacaaaaataaacattcaaagaagaatccaaaaaagtaagtgtgcctatgctatacaaggatacagtagtttccttttacaaagcctaagttttcttttagttgtcaactctgttctgaaaacattaaatggaaaattcc

SEQ ID NO: 201 - DNA, 622 bp, Mus musculus
  modified_base (494)..(495): a, c, g, t, unknown or other
  modified_base (505)..(506): a, c, g, t, unknown or other
  modified_base (518)..(518): a, c, g, t, unknown or other
  modified_base (540)..(540): a, c, g, t, unknown or other
gacataactgctggcctgaagggagccttggaaccggcagacaagatgagcgataaaccagacttgtcagaagttgaaacgtttgacaaatgaaagttgaagaaaactaatactgaagtaaaaaatactcttccgtcgaatgaaaacaagatgagcgataaaccagacttgtcagaagttgaaacatttgacaaagcaaagttgaagaaaactaatactgaagtaaaaaatactcttccgtcgaaggaaactatccagcaagagaaagaacacaatgaaagaacataaaatgagactctcctttcaagagcaacaacaacattgcctaacagtcatggctctaggcttgtttctgtaaccctatgcaatatatagacatgttaggcagctcctggtagatccatttactaccctggctgcaaaggtcagcatttgctatgaatcattaaatttttttggtactgctaaaaaaaaaaaaaaaaacaaaaaaatanncccctccttnnccacctggggtnctccttctcatcttcatcacanaagccactcacaactccaatgactattcgagctccaaggtagactagaaacagcaacggacggcatgatcgagacagtggat

SEQ ID NO: 202 - DNA, 531 bp, Mus musculus
cgatacagggtttctctgcatagccctggctgtcctggaactcactttgtagaccaggctggcctcgaactcagaaatcggtctgcctctgcctcccaagtgctgggatcaaaggcgtgagccaccactgcccagcgagatgcacacacttaatgccagtaataggtaggccgaggcaaaagaatttcgagtttaagcccatcctattttaggctacgcaatgagttccaggccagcacagtgagtcactatctcaaaacaaaacaaaacaaaacctgaaataaatataaccataagggaaccacagtcagcggctaaataggcagaacctgtaaacggtaattacacacacgttggtcaggctccctaggcagcaatcaagacaagctgtttctcatctctcaagttagcaaatatatgtaaaggtgtgggcatacagagtctggggatagttctgtgaagaacttgtctagcatgcttgaaagacctgagttttatttctccggggccaggatgtgtgtgaagactgtc

SEQ ID NO: 203 - DNA, 501 bp, Mus musculus
atgttaagaagagaacaacgtgagttcaaggccgagagacctctgaggtcgaagtgtggacacgcccacagcacggagccggtccacattcactgtaggttagtcagtgataatcttcccgccccctccaccaccttactttcctgagtcttcagcagcggctccatcccctggggctaacagcctgcaccagattgaaaacccaccttcctattccagcctttttaactacggcaggaccccaactcctgagaaccagggagcagcctctgagagagaacaggagctcatatacaccatttctgggcagggttcatcctcggagagatcatacactggacatcttcctctggacctgccccctagatatgaagaaaaagaaactgccccagccacacccttgggtgccccttctgatgcatccccgccatgagctatggactcaagcacagttttatatatatcatggattactattttatttaatttgttttttttaat

SEQ ID NO: 204 - DNA, 698 bp, Mus musculus
  modified_base (16)..(16): a, c, g, t, unknown or other
tgatctgaactgcccntaaaaggctacaaaactaacagataggaattcccttgccaataaattaaaactgttccccacagatgaaaccctggggtacagaaacccatggattatcaggaaatgtcattgaatccattacaggtcagggatcactgaaaaatgtcactgcttttcggctgcgtgtcccgcttccccagctggccccgtgctaagagcaggccgtatgggactccagctgttgctagcaactaattaaaccaccagtccagtaaatattgctcagcaaaacaacagaccaacctgccacggcctggcctcatcagccccagcaaagtgtattctcaggcctgtgacatggcttgtctcccaccaagccaccttgcagcggctatcctggtggccaggccttctagaggcgccccctttcctgcagagtcatcagtcagttcagtggacccaaggactgtcgcacatggaggacagaagccagcaggtcagtgtagggatggttgctttgcctgctactgtttgggagaggcctagacaaaggaggatgctgaccgctaagcagactcccatcttctaagtttatcctagtaggagagccaagtcaggtcactgccctgagtcacgtttatcacttaggtgccaccggcagcaatgtgttcctctttaaataaaataaatttaacaacctc

SEQ ID NO: 205 - DNA, 800 bp, Mus musculus
cccacgcgtccgattttgaaatcatttttgatacgtagtttattaggttttaacatcacagggcaatatttgttcaaagctcaaattctttgttactcagtgtctcccctccatatagcctggttgaccgcaattcagtccattttaatctttttttttttcacattagtgaatggttatatgaaatttagttatttatgaaattatctgccttcgttttacctaaaattgggtaactgatttgggagtagctgtatttaagtccataaaaaaaaaatcatctgatgctatggattcagagggctgcgcttcggctgtcccgttgctacaagaaccgccattttgtttgtgaagtgccaggcgagggggaaaaaaaaaggcagacactgtgtttgatgccaataatggttgccagtggcaccgaggttgggcatcagaccctcttggtctagctgctgaatgcctttgattcgtgggtgggcatccgcattgcagtgggcacactggaaagttttggacaatccctgaatgaaagcttcgtgctcgtctgctgcagcaaagctgggctaatagaaaacccttccccttttcttcccccaagaggctaaaaagaaacataacaaaaaacacacataaaaacagagatttgggccagattttagggaaaattttttctctaagagggggcctcaatttcccccaaagattgtttaaagaagtgtccaaggaattcctgggccccagggggtcacccatattcccccatttttgggtttttggttttatgggcttctcctcca

SEQ ID NO: 206 - DNA, 638 bp, Mus musculus
ttatgaggctgaatagtgggcctggcttctaggggtagagtttgctattattagccttctcttcctcatctgttccacctgtgtaagaggtggaactaagcttgtttaaaatgtgctttatatttagcaccaggattctagatgagctgggcattttgtctcttggctgcaatcccagtcccaggaagctgaggcaggaggattgctaagtgttctaggggagacatttgccttttaaaagtatgtgcaaactgggacttactacctcagattcctgtataaaatagggcatgctaggagatgagggaaattggggtaaattaaggggaaacattaggtattttaactgcctaatgcttcattctgaaactagagataactgctgtttgtacaagtcttcccaggggcctttccagatcttcacaccttaaaaattgcccccttaccaattgttgtttagggaaaaataattaaaaataagactactcatgccctgtattatacattacatctatgtgtaacttgtctccttcactagattgtaagcctttggaggtcagaaactcaacaaaaattgtatcttccaccacatctagcacagtgccttacacttatttgctattcaataaacattcatt

SEQ ID NO: 207 - DNA, 491 bp, Mus musculus
tttttttttttttttttaagatggaaacttgtcttaactgtcagtctgtctgtaatttatgattcctctgcatggtctgtgaccctggagaggttaagcctcagaactacactgtcctggtggtgctgcctagctcttagtgatctgtcccctgaatagggaaacaaacatgccagctccttgctgttccatgtagggcactaggtatgtggtttcaggtagtctgagggctatagctttcagtgtcagcacccactgcacacaggaatctaggaccagctgacagtaatctcaatctataacttctatcacgatccatgaaggtgggaaggggtgaccaaaaccaggacttaaaggtacagaagcacctctattctgcatggaacaaatcttaatgtgtaacagctgcagtcgtcatcactcccagggggtgggggccacattggatgtctaatattctctaggcaaaagatacaaccaactaaaaagta

SEQ ID NO: 208 - DNA, 525 bp, Mus musculus
tttttttttttttccaagacagggtttctctatatagctctagctgacctggaactcactttgtagaccaggctggcctcgaactcagaaatccgcctgcctctgcctcccgagtgctgggattagaggcgtgcgccataaatgtctgtttcccaaactgtaccagaaacagagcaagggctggagtcgcagcacagtaacagagtgcttgcttagtgtgtataaggccctgaattcaccccatggaccaggaattaaaaatactatcatcaatttggaggtataagtatgagcaccccagagatttgtattatttagatgaattgatggtttaatgaaaccaatgagacgcgtagaatgctaatgaatagcagtgagcctagaaaccaaccgtgagcaactaaaatcctggagtctacgtattcattctagagtaagtttttcccttctgaaaactatgtagcaactctactatagttcttaaatctctattactgatacttatgagctcattatattttctcg

SEQ ID NO: 209 - DNA, 4114 bp, Mus musculus
cctcgtgccgaggcaggggctgctgggcaaagtgcgcgggctgccgtcctggccaccgccaaagccatggcttccaaactcctgcgcgcggtcatcctcgggccgcccggctctggcaagggcaccgtttgcgaaaggatcgcccagaactttggcctccagcatctctccagcggccacttgttgcgggagaacctcaagaccggcacggaagttggtgacgtggcaaaacagtacctagaaaaaggtcttttggttccagatcacgtgatcacacgcctaatgatgtcagaactggagactcggagtgcccagcactggctgttagatggattcccgaggacattagtacaggcagaagccctggacggaatctgtgatgtggacctagtaatcagtttgaatattccttttgagacacttaaagatcgtctgagccgacggtggattcacccttctagcgggagggtctataacctggacttcaacccacctcaagtgcaggggattgatgacatcactggtgagccacttgtccaacaggaagatgataaacctgaagcagttgctgccaggctaagacggtacaaggatgcggcaaaaccagtcatcgaactgtacaagagccgtggagtgctccaccagttttctgggacggagactaacagaatctggccttatgtttacacacttttctccaacaagatcacacctattcaatccaaagaagcctactgagcctgccatgggaagaaccaagaagacgtggtcgcccactcgatcacacgtgtcgtcttggtgacctggcccagttagaagccagctgagatagcttgcagcatcttttctagtttcagtgatgaagtaatgaggaaactctagtaggtagaaggaattcaggaggaaggaaaccctcctctgcctttgaaaggggctctgcgggtgcatcacgcccttcacaggaacgagtatagactggatctccaccagtgttgagccacgtgctagctatcagagcctttttgcatgcagtggtgggctctttggtttatcccaccttccacaggctatgaaaccacagcgctgtatgcctgagcacttgaagggctgtggtcctggcttgtccattgccatatgctctgacaagttgacgctaattgcactcggtggttgcttttctccaatgactgtctctccctggctctcagacatcctcgtttctgttgtctgaatcttctcgtctgcttgctcccttctcaggctattcagtctcatgatggcttctgcatttacccctcgaatttcctttatacaaactgagaagtaggtgactgggttcagtcttttccttcttcctaggcactgatccaggtagaaggcttacttggttaaacagctgctctatcttgagcccactctgtaccttttattgtttaaaaaaagatccccccaaagtcttcagggttctcaaaaaacaagggaaatgcttacttatggaaaagtggggtgattgtatcttctatgtagaagtagtagtaattgtatggaaatcactggactaatgagatggttgggtgcaagaaaagatgaatattgaacatgctgctaaatattaacgctgtcagtgtttttcttctgtgagtgactaaccagacggcgagaggtcagaaaagggagcaagcctctgaggcttggagcatcttgcactagctatacacagcacctgcactgagtaagacagctttactgttgtggggatgcagagtccttttgtttgttttcttcctattccaaagatgcagtctataggtggtcataaagtccagaaatgaagatactaaggtcttatcagtcattgtgtgtcaagaaagcatttgtgaagactttccttcctggatctcagacttgctggccaccttgttacaatttttattcttttctgggaagaacagggaaatttcttcccactgccttaaaaaggtgtcctgcacctgcctgtccccaggaggtggtcttttattactggtggtgacttagtgtgacatctcatagtctgtgtggggtcagggtatggggtgggcttagcactttagtggattgagacattattccattctgaaggtgtcgtgtgttctgtgctcctgagtctgtctgccttcctgtactacctggactcccatggttcctctcagtcgtttttttcatgtgcatgttctgcggctgccttagtggagatgcaggccagcattcccactcgtgttctcagtacagagaagtaagcttccagagtgcagctgcacggggcaggtgaccatctgggcagtgtcgtgatgcagagcaccttggaagcttacatctggatgtcacttggtaggggttgggtgataaaagcccaggcttcctggaggggcaggtcgggagtgggaaaccctgagattattcccaggaaccaagggaagtagggagttaaagggattcagggtaattcaagagaggtaggaaaacttcaaacttttcttcccctcttgtggagtctggggagaacaatagggtgtgagcagctccttgcctgcacactgctgtttctctatgcagttcaagctcagtagactacggtagccccagtgggacaccaggctcagaagagcagcaaggggcaaagacatcttttccaaagtcttgggtgatttcatgtctatgggtgtaaaggtgttttctgcagcaggcttggctgattttgtggaaatggtcataaatactgaccgtgtcttgacaaaggtgcaatggaagcagcatctttgccttctcaggcgacacatggccaagagtctgggtgctctctgaggttctgactttacattcatggactccccgttcagcttgcatcccacaggcctcatgggaaaggctgcatgtttattcctccagtatttatgacaaaaaaggtgctatgaaggaggccctctgagtaaagtgcgcactctccggacctttataagcattgtggtgaatcttcccaggcacaaccaatatttcctataaacaagagtccaggatatgaagtcttgcccaggctcttcatatgagtaaacactaaagctatgattcagtcccaggttttcctgcttctgaaacccttggccttttacaggatgttatttgtctgtcttgacctaagcaacctggggccatgagcctgcttaggtctgcttgtggcctcagggagagtggctgcgtgaggctatttctttttatgctctttgcctaagcaaaaggagttcccagacacaagacgttaaggcaggctgggtttagaccaggtcaatctgcctcaattctaggcgtcaggaagccatatgaaagctgacatctactgaaacattaaaattaaccataacggttacccttatttttggtgtggcaaactgcacaattcttgccagaacaaatgccatcaactgcctcagggcactccttggtttgactgttctttatgtggttgggtgtgagggagacaggaagccattgcccaggactccatcctgactccctctagtgacagacaggaagcacagtgtcttttaataaaaggctcctgtttaaaacctttgcagggagtaccgcaccttctctctgggatttgggaaaagggaagaaaaattgaaaaccccaggctctgtgtggactgcaagaaatggtagagctcaaggcttctctagtcttatgagaacttgtactactgaatttgcgaattttgtttttttgagctggaccgatctctgggggacgacgttgagctaggatggcatttcactgtgatcccccaagttcaagccagtctttaactcagtgttggcttaagtttccctggagctggcacgtcagcttttcttcagtgacagttggtgttcctcttgatttgggtatatgtgcttagttcagagtctgttctgtatctgctatcctaactattcattgtattcattgatttttgttttgttttgttaccttgcttgaagattgatttgtattgaatttgatagaaataaatgttttttccgcttaaaaaaaaaaaaaaaaaaaaaaaaaaaaaaaaaaaaaaaaaaaaaaaaaa

SEQ ID NO: 210 - DNA, 590 bp, Mus musculus
  modified_base (101)..(101): a, c, g, t, unknown or other
  modified_base (137)..(137): a, c, g, t, unknown or other
  modified_base (377)..(377): a, c, g, t, unknown or other
  modified_base (388)..(388): a, c, g, t, unknown or other
  modified_base (414)..(414): a, c, g, t, unknown or other
  modified_base (424)..(424): a, c, g, t, unknown or other
  modified_base (512)..(512): a, c, g, t, unknown or other
  modified_base (536)..(536): a, c, g, t, unknown or other
  modified_base (549)..(549): a, c, g, t, unknown or other
  modified_base (551)..(551): a, c, g, t, unknown or other
  modified_base (566)..(566): a, c, g, t, unknown or other
gtgcacttaagtttcttttgatttatttgcttcacgtgtttagttgtcttctagtagctattttaaccattggttttaatctttacattttttccagaagnattcaaaaatatgtatttttatttctgttggccagntttttttcatcacttgacaaaagtgcctggaaataaaaatcggcttaaaggaggaaagctttgcatctgactcgcagtctgaagctccctcctatggcacttggtcctaaagaatcagaacatcatggtaggaaacacagggaagccacgtgccttcccctcacgtggtagggatgcagggatgcagggatgcagggatgcagggatgcagggatgcagggatgccaggatgcaagggtnaaggtacaggngataagggtacaccatttccaggggnacgttccctncatgagccgggttctccatccaggctcaacctcctagttctcacgggctcccaattctgcttagtttgtaaagtgtagagcaatcccntgatgacatcagagcctgatgctnggaatcatgttanancccccaaatcttagncataaacgttctgcactgagcacc

SEQ ID NO: 211 - DNA, 462 bp, Mus musculus
ttttttcaatgtttaatcacacaatttttattagaattcagaccaaaatattaaaactataaaaataaagacacttatttctctggagctgattttgtttgccctttttatgtacaggggatccaaacttctacagcaaaaacttgctgcttttaggaaagacatacttgaagctaaacaacaaaaagcttgctgcgttctggttggtaaaagccaagggttatccagcacacacagaagaagataaacaggtaaaatatctataataaagtaaggcagataggctttctttcaggcattagtaaatgaatgaactgagaacatccttaaaagagaaactgtttaaatgcatagtgttgtggaaagctcatccaagtgctcatttctatattcacctttacactttaccatgagtgctccttagtgactatcatcaaatgccagctggaagctgcttgctgc

SEQ ID NO: 212 - DNA, 724 bp, Mus musculus
ggtcttgtgtttttcctttctgctggaatgtggttgctaagcaattaagcttcttccagtccttaattaccactggcccattgagtttggatcagaggggttgagttggctttctctggctggttgcctaatcaggtgtctcacatagtcagaggacaggatgaagtgatgtgtgttgaaaacagtgagcttctctttgtagagttaagcaaagacaaggcattgtggttaaaagggttagttgaacttttaaaaaatatgctttggtattctttttcgaacatattgtgtcatgaagacgctaaactgtaacagcactctccttatatgagaaaggcaaagttgtgtaagaatctgttgctgctacggatgattctcactgcagtgtggtcatccaagccatggccataagacagcacactgccaccttctgtaatctttgccactgaaaagcttctctctttctttgttgatattcttgagtgactttgtagataaacaaaaattatatgtgacaatgtaaaaggaggttgttaaatttgttgccgcctcaatcataaaaaattcaggaagaaagccttaaactaaactcttatgactggaaaattcaggtttggcatttgtagtatggcagccacacagaacatgctgggcattgttagatggtctgtagactcactttcttctaatggactgtgttatttaacgcccctatcttcctttg

SEQ ID NO: 213 - DNA, 673 bp, Mus musculus
acttcaagattagatctgatccctggaaaaagtgcatttaaaaaaattagtttccgtcagatgtggtggcccacacctataatcaagaggctgagacagaagggtggagaattctaggccagcgtaagttacatgcctcatgcctatcctcaagcctcaggaaggtgatgcaggagaattgccaagagttaaaagccaaccttgggctacagaataagaccccactcaaaaaagaaaacaaaacaaaaaaatgtaattttttttcttttaaaagtgcattattgcctgcacatacattacattacacacacattaccacatgcattatattacatcacatacacactcagatcaccacagtgtacatgtggtggccagaggacaattttgcggaatcttcttctacttccgtcttggtgtgtatttgggggagttgaattcaggtcaccagattccgtggcaagcacctttacccactgagctgtctcactggcccagggtttggtttggttttccttgtgttcattaaaaaaggaaagatgaaagacattgtggcacacattcaatcccagcactcaggaggtaggtgggtcttcatgagttccaggccagcctgggttaagtggtaagagccatgcccttttccccactcctcacctctccccctcctccc

SEQ ID NO: 214 - DNA, 673 bp, Mus musculus
atcagaaagcacatgatgctgaagaagcagtgttttctaaaagggaaacactttgacaggggcaacactgttcctttgcagtagctaatgagctaggaggactcaaatcatgagagccagtcagtgagatggcttagtgggtaaagaagcttgttgccaagttagtctccagcatgcacaggatggcaggaaaaaactgactcctgcaagttattatctgacatccttatggatactggcacatgcatgcactcacaggtatataatcacactcatatagacacctcgagatagaccacctctaaaccagagttagacaagacatggcttcccagaagcacacatctgttcaatgacaccagggtccttaagccctattgtccctcttctataggagctctgtgaaagctgttgggtccaaggaaaaccagcttacttaaacgtaaaaaattataagcagttacgagaccagatctttagagaacacgttaaagaaaataatggaggggctggagagatggcttagaagttaaatatactgattgctcttccagaggccctgaattcaattcccagcacccatggcttacaatcaattataatgggatcctttgaccttttctggtatgtctgaagacagtaacagtgtactcacatacataaaataaatctc

SEQ ID NO: 215 - DNA, 306 bp, Mus musculus
ttttgatcatttgggagccttcgtccttggagaagtgtgcaaagaggaaaccagatatacctcatagattgttacctttcctaaagccagagtcaagtcagttttgagtaataaaatggtatttgtaatgttttcttgccaattaaatgaattccatttagtttgagactttgaagcttttgtataaactagatatttgtttttttaatttcagatcaatgtttcaagagtaaaagttcactcattaactcactaattttggaaaacctgttttaaaaatattaaaatggatttatatttctgtag

SEQ ID NO: 216 - DNA, 3034 bp, Mus musculus
gtgctccagatcccatcatgcttggcctctggctgctcagcgtcttatggacaccagcagtagcccctggacctcctttgccccatgtgaaacagtatgaagtggtttggcctcggcgcctagctgcatcccgctcccgcagagccctgccctcccactggggccagtacccagagagtctgagctatgctcttgggaccagcgggcacgttttcaccctgcaccttcgaaagaacagggacctgctgggctcaagctacacagagacctactcagctgccaatggctctgaggtgacagagcaactgcaggagcaggaccattgcctctaccaaggccatgtggaagggtacgagggctcagctgccagtattagcacctgtgctggcctcaggggctttttccgagttgggtccactgtccacttgattgagcctctggatgctgatgaagaggggcaacatgcgatgtatcaggcaaagcatctgcaacagaaggctgggacctgtggggtcaaagataccaacctgaatgacctagggcctcgggcattagaaatatacagggctcagccacggaactggctgatacccagagaaacccgctatgtggagttgtatgtggttgcagacagccaagagttccagaagttggggagcagagaggccgtgcgccagcgagtgctggaggttgtaaaccacgtggacaagctttatcaggaactcagttttcgagttgtcctggtgggcctggagatctggaacaaggacaaattctacatcagccgctatgccaacgtgacactggagaacttcttgtcctggagggaacagaacttgcaagggcagcacccacatgacaacgtgcaacttatcacgggggttgatttcattgggagcactgttggactggctaaggtgtctgccctgtgttcccgtcactccggagctgtgaatcaggaccactccaagaactccattggtgtagcctccaccatggcccatgagctgggccacaacctgggcatgagccatgatgaggacattccaggatgctactgtcctgaaccacgggagggtggtggctgcatcatgaccgaaagcatcggctccaagttccccaggatattcagcaggtgtagcaagattgacctagagtcattcgtgacaaaaccccagacaggctgcctgaccaatgttccagatgtcaaccggttcgtgggtggccctgtgtgtggaaacctgtttgtggagcatggagagcagtgtgactgtggcacacctcaggactgtcaaaacccctgctgcaatgccaccacttgccagctggtcaagggggcagagtgtgccagtggtacctgttgtcatgaatgcaaggtgaagccagctggagaggtgtgtcgtctcagtaaggacaaatgtgacctggaggagttctgtgatggccggaagccaacatgtcccgaagatgccttccaacagaatggcactccctgcccagggggctactgctttgatgggagctgtcccaccctggcacagcagtgccgggatctgtgggggccaggtgctcgggtagcagccgactcctgctatacctttagcatccctccgggctgcaatgggaggatgtactctggcaggatcaaccggtgtggagcgctgtactgtgagggaggccagaagccccttgaacgctccttctgcactttctcctccaaccatggagtctgccatgctcttggcacaggcagcaacattgacacctttgagctggtattgcagggcaccaagtgcgaggagggaaaggtttgcatggatggaagctgccaggacctccgtgtatacagatctgaaaactgctctgctaaatgcaacaaccatggggtatgcaaccacaagagggagtgccactgtcacaagggctgggcaccacccaactgtgtacagcggctggcagatgtatcagatgaacaagcagcgtctacgagcctcccagtcagtgtggttgtggtcttggtgatcctggtggctgcgatggtcatcgtggcaggcatcgtcatctaccgaaaggctccgagacaaatccagaggaggagtgtggcacccaagcctatctcggggctctccaaccccctattctacacaagggacagcagcctgccagctaagaacaggcctccagacccttctgagacagtttctaccaaccagcccccaagacccatagtgaaaccaaagaggcctccccctgcacctccaggtgctgtgtccagttcaccactcccagttcctgtttatgccccaaagataccaaatcagtttagacctgatcctcccaccaagcccctcccagagctgaaacccaagcaggtcaagccaacctttgcacccccgacaccaccagtcaagcccgggactggagggacggtgcctggagcaactcagggagctggtgagccaaaggttgctctgaaggtccccatccagaagaggtgaccagctagggcaccccagggccatcgtttgtggacgtttggagataccactgctcctataaatgtgttccttcagcaacaccacaaccaccacccaggctggacctgcacacgctgttcctacctcaggaataatctttctgtggctcttgctgtccagatgccctcatgaaccagtggcctctcactggccttggccagcttagaccatacatcagcgtatgctagttgctaggcaggggcggtgtaccctgcagtgggcgtgatcaagtctgtctgtctctgggtggacagaatgccaggagtcccctcccagcaacttctgcactggccctcacacagtgacctctctccaaggcacagttcctgtatctacatcccactcgtgtatgagacttaggaaaggaaaagacgtcgttcttggggtgttgggacaagaagttgccgtcatctccggattgaaacagattagttgttgaaattatgactaaacactattcactaataaagattctattttatcaatagattatagat

SEQ ID NO: 217 - DNA, 3790 bp, Mus musculus
aggagcgcccagttgctgccggagctgggcccgccagaacctctcctggagccccttgctctccttgaatctccctttcccaccgctttctggatacccttgacgcccacgttcctcgcgccctttccgcccctacgcggcggctgcccctgccacccaagtccctgctcaagcccgcccggtcccgcgcgtgcccagagccatggctccagtgcgcaccgcatccctgctctgcggcctcctggcactgctgacgctgtgccctgaggggaacccacagacggtgctgacggacgacgagatcgaggagttcctcgaaggcttcctttcggagttggagacccagtccccgccccgggaagacgacgtggaagtccagccgcttcccgaacccacccagcgtccccgcaaatccaaggcagggggcaagcagcgggcagatgtagaagtccctccagaaaaaaacaaagacaaagagaagaaaggaaagaaggacaaaggccccaaagccacaaaacccctggagggctctaccaggcccaccaagaaaccaaaggagaagccacccaaggccaccaagaagcccaaggagaaaccacccaaggccaccaagaagcccaaggagaagccacccaaggccaccaagaagcctaaggagaagccacccaaggccactaagaggccctcggcaggaaagaagttctcaactgtggcccccttggaaacgctggatcggttactcccctcaccctccaaccccagcgcccaggagctaccgcagaagagagacacacccttcccaaatgcctggcaaggtcaaggagaagagacccaggtggaggccaagcagccccggccagagccagaggaggagactgagatgcccacactggactacaatgaccagatagagaaggaggattacgaggattttgagtacatccgtcgccagaagcagcccaggccaacacccagcaggaggaggctctggccagagcgccctgaggagaagactgaagagccagaggaaaggaaggaagtcgagccacctctgaagcccctgctgcctccggactatggggatagctacgtgatccccaactatgatgacttggactattatttcccccaccctccaccgcagaagcctgatgttggacaagaggtggatgaggaaaaggaagagatgaagaagcccaaaaaggagggtagtagccccaaggaggacacagaggacaagtggaccgtggagaaaaacaaggaccacaaagggccccggaagggtgaggagctggaggaggagtgggcgccagtggagaaaatcaagtgcccacctattgggatggagtcacaccgcattgaggacaaccagatccgtgcctcctccatgctgcgccacggcctcggagcccagcggggccggctcaacatgcaggctggtgccaatgaagatgactactatgacggggcatggtgtgctgaggacgagtcgcagacccagtggatcgaggtggacacccgaaggacaactcggttcacgggcgtcatcactcagggccgtgactccagcatccatgacgacttcgtgactaccttctttgtgggcttcagcaatgacagccagacctgggtgatgtacaccaatggctacgaggaaatgaccttctatggaaatgtggacaaggacacacctgtgctgagcgagctccctgagccagttgtggcccgtttcatccgcatctatccactcacctggaacggtagcctgtgcatgcgcctggaggtgctaggctgccccgtgacccctgtctacagctactacgcacagaatgaggtggtaactactgacagcctggacttccggcaccacagctacaaggacatgcgccagctgatgaaggctgtcaatgaggagtgccccacaatcactcgcacatacagcctgggcaagagttcacgagggctcaagatctacgcaatggaaatctcagacaaccctggggatcatgaactgggggagcccgagttccgctacacagccgggatccacggcaatgaggtgctaggccgagagctcctgctcctgctcatgcaatacctatgccaggagtaccgcgatgggaacccgagagtgcgcaacctggtgcaggacacacgcatccacctggtgccctcgctgaaccctgatggctatgaggtggcagcgcagatgggctcagagtttgggaactgggcactggggctgtggactgaggagggctttgacatcttcgaggacttcccagatctcaactctgtgctctgggcagctgaggagaagaaatgggtcccctacagggtcccaaacaataacttgccaatccctgaacgttacctgtccccagatgccacggtctccacagaagtccgggccattatttcctggatggagaagaacccctttgtgctgggtgcaaatctgaacggtggtgagcggcttgtgtcttatccctatgacatggcccggacacctagccaggagcagctgttggccgaggcactggcagctgcccgcggagaagatgatgacggggtgtctgaggcccaggagactccagatcacgctattttccgctggctggccatctcatttgcctccgcccatctcaccatgacggagccctaccggggagggtgccaggcccaggactacaccagcggcatgggcattgtcaacggggccaagtggaatcctcgctctgggactttcaatgactttagctacctgcacacaaactgtctggagctctccgtatacctgggctgtgacaagttcccccacgagagtgagctaccccgagaatgggagaacaacaaagaagcgctgctcaccttcatggagcaggtgcaccgtggcattaagggtgtggtgacagatgagcaaggcatccccattgccaatgccaccatctctgtgagtggcatcaaccatggtgtgaagacagcaagtggaggtgactactggcgcattctgaacccgggtgagtaccgtgtgacagctcacgcagagggctacacctcaagtgccaagatctgcaatgtggactacgatattggggccactcagtgcaacttcatcctggctcgatccaactggaagcgcattcgggagatcttggctatgaacgggaaccgtcccattctcggagttgacccctcacgacccatgaccccccagcagcggcgcatgcagcagcgccgtctacagtaccggctccgcatgagggaacagatgcgactgcgtcgcctcaattctaccgcaggccctgccacaagccccactcctgcccttatgcctcccccttcccctacaccagccattaccttgaggccctgggaagttctacccactaccactgcaggctgggaggagtcagagactgagacctatacagaagtagtgacagagtttgagacagagtatgggactgacctagaggtggaagagatagaggaggaggaggaggaggaggaggaagagatggacacaggccttacatttccactcacaacagtggagacctacacagtgaactttggggacttctgagactgggatctcaaagccctgcccaattcaaactaaggcagcacctcccaagcctgtgccagcagacacatagccatcagatgtccctgggtggaccccactcccccagtgtgggacatcaaagctaccgggactctgcatagactctggtctacccgccccagctctacctgccagcctttggggaggggcaggcaagga

SEQ ID NO: 218 - DNA, 2037 bp, Mus musculus
gccatggcagggccaaagccagagagaggggaggtgacagcgggaacaggataggatcatgggctgctgtgtgtctagtgaaccccaagaagagggaggcagaaagactggagagaagctgaagaaggccaagatcatctttgtggtgggcggacctggctcaggaaagggcacccagtgcgagaagattgtacagaaatatggctacacccacctgtctactggggacctgcttcgggcagaagtcagctctggatcggagaggggcaagaagctgtcggctatcatggagaagggagagctagtgccactggacacggtgctggacatgctccgagatgctatgttagccaaagtggattcttccaatggcttcctgatcgacggctacccgagggaggtgaaacagggagaagaatttgaacagaagattggacagcccacactgctgctgtatgtggacgcaggcgccgagaccatgacccaacgactcctgaagcgaggggagaccagtggccgcgtggatgacaacgaggagaccatcaagaagcggctggagacttattacaatgccacagaacctgtcatctccttctatgacaagcgtggcattgtgcgcaaggtcaatgccgaaggcacggtggacactgtcttctctgaggtctgcacctatcttgactccctgaagtaactggatcccttggccagctcccagcccgccccacccttgctccctgaccccaggcagcctggctcaagcccagcacctccaccctgccgggctgtgcacagacacaggaagccatgttatcctgtcccatggacactaaagaaattgccaaggagggttaggattgctcctttcctttgcttccagttatggtgattcatgctgccacagccggaggccccagcgtggccggcccattcttccctgtgcctcagcccagctgtcttgtctccctctggctctgctgggatcctaggcccttccttagccaggctgtgtcaaagcctaggggtccctgggttggcaggctgctctggggggtctggtgttcaccctgtttctcatagcctcgttgtgtggctttggccctaagccattgtctctctggagtgagttttctttttttctttctttctttttcttttttttctttctctgtttctttctttttttttttttttttaagacagcatctcgtgtgacttaagctggcctcaaccctgttatgtaactaagggcaaccttaatccttctgcctccacttgtctccctgtgtgctgagattacaggtgtgtgtgtggacctccaccactctctgtttttgggggcactgggaatcaagcccatgcccctgtatacgaggccagcacgctacagagtgagctgcatcccgggctgggcaggttttctgtgcctgactggggtctggcatgggcaaagggcaaagggccatgggctcaccagctggggccacgtggtcactgggtgccaaggagctgtgcaatgggcatacagctaggtgggaagctggggtcaggggtggccttcctgaagaaggctcccttggtatagacctgccaggccttgccatcctttggctggttttaaagcttgtcctgtcacgctatgtcccaacccttatcctcggcgttaagacaagagcatgcagattaaggagtgtgagctgccatagacaaggatgtgggatcaaggaccaggcctgggacccggagaggacacccagggatgccaagaagagctggcatctctcttctgctctttattctttggtctcattacacaggaagcctctgtggtactcacttgtcctggggccccgtctccatccctagtgacttcccctgtaagcccagatagcctgtaagccagcagccatggctgtcccagggacacctgcccctgggggtgacggtgctcactcctttctgtttactaccagtggggccacctttccttctgcattgcctatttaagctgtcctttaaaataaataaatgtatttcaga

SEQ ID NO: 219 - DNA, 1914 bp, Mus musculus
ccacgcgtccgcggacgcgtgggtgtgtccagtcactgagcagaggccaactagtgtttcttcatctccctgggaaaagcagcagacaggatggcctggtggaaagcctgggttgaacaggagggcgtcagcgtgaagggtagttctcatttcaacccagaccctgatgcagagaccctctacaaagccatgaaggggattggaaccaatgagcaggccatcatagacgtgctcaccaagaggagcaatgtgcagaggcagcagattgccaagtccttcaaggctcaatttggaaaggacctcactgagaccttaaagtcagagctgagtggcaaatttgagagactcatcgtggccctcatgtacccgccatacagctacgaggccaaggagctgcacgatgccatgaagggcttaggaaccaaagaaggagtcatcattgagatcctagcttctcggaccaagaaccagctgagagagataatgaaggcatatgaggaagactatggatctaccctggaagaagacatccaaggagacacgagtggctatctggagcggattctggtgtgtctcctgcagggcagcagagatgatgtgagcggctttgtggatccaggactggtcctccaagatgcacaggccctgcatgaagcgggtgagaagattatgggaaccgatgagatgaagttcatcactatcctgtgcacacgcagtgccactcacctgatgagagtgttcgaggaatatgaaaaaattgccaacaagtgcattgaggatagcatcaagagtgagacccatggttcgctggaggaggccatgctcactgtggtgaaatgcacccggaacgtccacagctactttgcagagagactctactacgccatgaagggagcagggacacgtgatggaacgctgataaggaacattgtttccaggagtgagattgacttaaatcttatcaagggtcagtttaagaagatgtacggcaagactctcagcagcatgatcatggccgacaccagtggttactacaagactgccctgctgaaccttgtgggcactgacctctgaaaatgtcaaaaaatagaacaagggcaagaagtgtgagcccagcccctgcagcttcagccccgaccatgggtgggggtaggggacacctcatctggcttttagtcttctgttgcccagtttctgatgcttctcatcccatgcttctgacccggatgatgagaccagcctgggtttcccttccacctctcccgtcagtcatttctaggtatgtgtataccgcccaccctagcattacctctgagcaaacggaaacatcaacatgaagaaagaagcttgcagtgtcctgtgggtcattccttccccttcacacaaaatctcctgggcacagggcacacagatgccttggctctgacccatctactgagtcagggtcttcagaggaagaaccaaggaacatggatttctagcagttgtcttagctgctaagcatcattatcaggcagccagtgagcatgtgggagagcacctctatgagaggacacggccgtggatctgagaaagggtcacatagctctgccaatcgggacactcacttaacggaaattgttaggctctaggtggaggaaaattcttacaccatcctaatagcacgcattagatgggattacaaatccccgtcctgacccaagtacgctgtggtctgagaaactcgggcttgtccagtcattccctccatgctgaagcttgcagactagggagccgcccagccctgagcatgaatcccatcctctgatcgtggtctccgagcctgaagaacatgacagaactcttctcaatattcgttgggctttcagaatcataaacatttgtactttcaaaaaaaaaaaaaaaaaaaaaaaa

SEQ ID NO: 220 - DNA, 1645 bp, Mus musculus
gcttataaccctggatgcgcgcctctctcagccctgctccgccgtctgccactgccgcctgggctcactgagtggttcatctggccaggaaagcagactacacggactccagggacctgtacctataatccaagacaagatgtccagcaagggctctgtggttctggcctacagtggtggcctggacacctcctgcatcctcgtgtggctgaaggaacaaggctatgatgtcatcgcctacctggccaacattggccagaaggaagactttgaggaagccaggaagaaggcgctgaagcttggggccaaaaaggtgttcattgaggatgtgagcaaggaatttgtggaagagttcatctggcctgctgtccagtccagtgcactctacgaggaccgctatctcctgggcacctctctcgccaggccttgcatagctcgcagacaggtggagattgcccagcgtgaaggggccaagtatgtgtctcacggcgccacgggaaaggggaatgaccaggtccgctttgagctcacctgctactcactggcaccccagattaaggtcatcgctccctggaggatgcctgagttttacaaccggttcaagggccgaaatgatctgatggagtatgcaaagcaacacggaatccccatccctgtcacccccaagagcccctggagtatggatgaaaacctcatgcacatcagctatgaggctgggatcctggaaaaccccaagaatcaagcacctccgggtctctacacaaaaactcaggaccctgccaaagcacccaacagcccagatgtccttgagatagaattcaaaaaaggggtccctgtgaaggtgaccaacatcaaagatggcacaacccgcaccacatccctggaactcttcatgtacctgaacgaagttgcgggcaagcacggagtgggtcgcattgacatcgtggagaaccgcttcattggaatgaagtcccgaggtatctacgagaccccagcagggaccatcctttaccacgctcatttagacatagaggccttcacgatggatcgggaagtacgcaaaatcaagcagggcctgggcctcaaattcgcagagctcgtatacacaggtttctggcacagccctgaatgtgaatttgttcgccactgtatccagaagtcccaggagcgggtagaagggaaggtgcaggtgtctgtcttcaagggccaagtgtacatcctcggtcgggagtctccactttcactctacaatgaagagctggtgagcatgaacgtacagggcgactatgagcccatcgacgccactggcttcatcaatatcaactcgctcaggctgaaggagtaccatcgccttcagagcaaggtcactgccaaatagaccctgacaaagaggagcgggcctccccactctgcagctctcccaggcttcagcattaattgttgtgataaatttgtaattgtagcttgttctccaccacctgactggggctgctgtgtcccccccgcccccccacagcctttgttccctggtcccctatagcctacaaaagtggtcatcgaagggaagggagggtggcgggcagctgcagaaagcataaaatgacaattaaaagaagttacattagtctttaaaaaaaaaaaaaaa

SEQ ID NO: 221 - DNA, 3083 bp, Mus musculus
gagtggtatgaaaggcgcagcccggggaaagtccgggcagagcccgagaggtggccagaccgtcatcatcgttctaatacagctacttcctcagccaccggtatgagccacgggaagagaaccgacatgctcccggagatcgccgccgccgtgggtttcctctccagtctcctgaggactcggggctgcgtgagcgagcagagactcaaggttttcagtagggcgctccaggacgcactgaccgatcattacaaacaccactggtttccagaaaaaccatccaaaggttctggctatcgctgtatccgtatcaaccacaagatggaccccatcatcagcaaggtggccagccagattggactcagccagccccagctgcaccggctgctgcccagtgagctgaccctgtgggttgatccctatgaagtgtcttaccgcatcggggaggatggctccatctgtgtcctgtatgaggaggccccggtggctgcctcctatgggctcctcacctgcaagaaccagatgatgctgggcaggagcagcccctcgaagaactatgtgatggccgtctccagctagataggagccacccgaccctggcactctactgttctcatgctgccctgacaacaggccaccgtatacctcaacctggggaactgtatttttaaaatgaagagctatttatacatgttttttttttttttttttaagaaaagaggaaaaaaaccaaaagattttttttaaaaaaaaaagaaaaagaaaaacaattctttaaagggagctgcttggaagtggcctccccaggtgcctttggagagaactgttcttgattgcatctgtgagccagtgtttgcctaggggaatgggttggggattggcctagccaaggtaaaaggggattcttggctgatccccccaggaggtggtggaagggagcaaggttagcaactgtgaatgagaggggtcagggtctgctctgggttaccgtcccagctgggatgcctgtatgcctggtccctctcttactcaggggcattcaagcctgatcttaaataatactacattgcctaatcttctcttttgtttttcggctgagatcaggggcagactgaaaggcctctcctgtcccttctgttctaagcagtctcttgaagccgtgtctcgtttctgagtctacccttgggggcctgaagagcttgcttcccagcccggaatctgtctaaacattttttggagggtgggatgtaaggcaggcgcgcaaagactttggggctaagatggagaggacctgcacaaaacctttgctttgctctgtgctgctttgtatgggtggatagtgaataatttagggatgatttgcaatggaattttgggacccaaagagtatccaatgggggtaggtcttttggacccagtccttccttttgggaaccacacgacagtctgaatgctgctaccactattcctttgagaggtggctcaaagctccagggaactccaagtcctttcttactgccttctcttcaagagcaaccttccccattttttctttcccctttcctgcggttgggtcctggagggccctatttcctaggacaagcgttctcagtcactgtgcaatagtcccaggatgctctgagaccggacctcccagcccctcctgatgccctggtaggttttagggacccattcttcccattcttctaggggttctgactggctggtgggccttgcggagatcttcctgggccacagggagggcacctgtgcactgcaggactacctggtattcttgtagggctgccatgaagagtcaaaccttgggcacagctttagctccttggtgctcagagcacctgtgggggaggttacctctctctctctcttagtaaaatccaaatttatttgtagatgtgtgcaatatttactgttctgggttggagaaaattgggaaacactgggaagaaatggctttccttcaggttcagtgacactgatgagggcttcttagaaggcctcaagtctctcaaactgaaggacagagctagagctagcccgtcaccccttggtgaggattcccttccccgtttctctccaccgccatggcatcctgtgtcctagatttctcagctcctcagtttctgctcaaaggtgctatttaccaaactctctgcctgcccgggcagacaggccccagcttcgcacagccttcccaggtggcttcgtctctcttgctttaaccttaactctgggcccacagacctgagagctgtggcctacaacaaagctgtgaattgttccagatggttcttgtgttttgtccgcacacaggtgcctgccgtttagaagctgcctcctggtctcatgcttaaatcttcaattctttactgtccttgttcactttagaaatgacaaaccctagagctggactgttgagcaggcctgtctctcttattaagtaaaaataagaaatagtggtaagtttgtaagctattctgacagaaaagacaaaggttactaattgtataatagcgcttttatatggaagactgtacagctttatggacaaatgtaaactttcttttttgtttttaataaaaatgtagcagatcgtgtaatgtgtagagaaggtggaattccatagcgctgactggccctcttagatacaaaccccttcgtgtttcgtggacttcatcagttgtcctgagctccgtctgcagcatgcagacgttataaaagataccctaggtttgtgacgaggttgcttccattgcatcccctctccttgggaggcggctccatacttctgtccttgtgaatattgtcacaggtctcttaaaaaacaaacaaacaaaaaagcccaaaaaccaatatgttatctgcacactctgcagccagttccatagttttgctcttggccattcagcacattgaagagctggccagctgtgtccacatctgcgcaagcaagccaccacggctggaaactatataaagaaaagaaaccatccagaaagttccaaagacacaagacttgggtttggcacacactaagcacaccagtgcactcgatgcgactg

SEQ ID NO: 222 - DNA, 707 bp, Mus musculus
  modified_base (2)..(2): a, c, g, t, unknown or other
  modified_base (38)..(39): a, c, g, t, unknown or other
  modified_base (74)..(74): a, c, g, t, unknown or other
  modified_base (96)..(96): a, c, g, t, unknown or other
tngccccgggttttaagcttttctgcaccagcgcactnngcttccgggggcaggaagcccccagttgccagttntctttaagccctttttagaagnctgtaatttggccgagagcgaatagacctgttttgccccgagtttcagaacaataagaattctctagaaaccctactgggaagtataggcagatctctccctcatataactgatgtttcttggcgcttggagtaccagataaagaccaaccaacttcataagatgtaccgacctggatatttggtgaccttaaatgtagagaacaatgattcccaatcctacccagagattaattttagttgcaacatggaacagttacaggacttggtggggaaacttaaggatgcttcaaaaagcctggaaagagcaactcagttgtaatttggggaggctgatgaccccaggagcctagaggaaaaccagacgcgccttgtctcctgctggaccatcgttcgcgcgagctggatgtcattttcagtggaaaaagagctagcacccttttgaagtgatgccaaccatcaattttgacactttttttacacatgtgaaatggttaagagggagactcttaagcatctggattttcagtattactcttgcgttccttctatcttgagcgtcttcaagccctattaaagtatcgtaccctgaataaatacggtggtattccc

SEQ ID NO: 223 - DNA, 311 bp, Mus musculus
  modified_base (30)..(30): a, c, g, t, unknown or other
tcttcatcacacacccttctctttgacctnccatgccacacccagaacttctcaaagactttatatttctctccagtataaatttatatgccgaacacacggatccataccttgaagctggcggtggggatttctattgtagccaccacattggtttttccataatcacccggggtttttacatttttaggggggagagaaacacaaatttttacaccaatatatggacctagcttaaggcgattttaatcccctttcctaggcaggtaataataaaagttgagttgttttttgttttttgtttttccacg

SEQ ID NO: 224 - DNA, 994 bp, Mus musculus
gtcagcagcatgaagctgaatttcagtggcctgagggccctggtgacaggggcagggaaagggattggacgggacactgtgaaggccctgcacgcctcaggagccaaagtggtggcggtgactcggaccaactcagacctggtcagccttgccaaagagtgtcccggaatagagcccgtgtgtgtggacctgggtgactgggatgccacagagaaggcgctgggcggtatcggccctgtggacttactggtgaacaatgcagcgctggttataatgcagcccttcctggaagttaccaaggaagcctttgacaggtccttcagtgtaaatcttcgctctgtgtttcaggtatcccagatggtagccagggacatgattaaccgtggcgtgccagggtccattgtcaatgtctccagcatggtggcccatgtcacctttcctaacttgatcacctacagctccaccaagggagcgatgactatgctgaccaaagccatggccatggaactagggccacacaagatccgggtaaactccgtaaaccccactgtggtgctgactgacatgggcaagaaagtctctgcagaccctgagtttgccaggaagctcaaggagcgccacccactgaggaagttcgcagaggttgaagacgtcgtcaacagcatcctcttcctgctcagcgacagaagtgcctctaccagtggcggtggcatcctggtggatgctggctacctggcctcctagtctgctcagttgccgcggacatctgagtggccttcttagccccaccctcagccaaagcatttactgatctcgtgactccgccctcatgctacagccacgcccaccacgcagctcacagttccacccccatgttactgtcgatcccacaaccactccaggcgcagaccttgttctctttgtccactttgttgggctcatttgcctaaataaacgggccaccgcgttacctttaaaaaaaaaaaaaaaaaaa

SEQ ID NO: 225 - DNA, 672 bp, Mus musculus
tttttttttttgttttttgtggtttttttttgtcaaagataggcacctgttgaaactgagtggctactgtaagtcagtaaggcacttttcccccacaagtgggctgcaggaaaaggaacggatctgcagctccatcaagggtgtgtatgtattgatggcttcgtaaaaccagagccaagaacgggtctcacagcccagccacgtttaaaatcggagtagcgcatgttccggctcgaggactcttttgtgctgttgaaaatccagaaacatcaaaagccacatggtatatggaagctataacacctcctggggcttccctacactatttcgtacaaatagataagcatgccgcagctgttgaccaccacctggagtctgcactgagagaagcctatgtgtgcggtgtgcacctatggagggcttgtcggcttaaggggacttcactgtctcagtattaattcccctttttaaagctattcccaaggttggactgtctaaggtaagcaagggggagtcctttgggcttagaggtcagctggcttacttagacttctgattgctacctccagttcccacaccactgtccaggacacagggacaagtgtggtcctcccagccctgtcctcatggagacaaagctcctctgccttctttgtgaaagcaccctgtctt

SEQ ID NO: 226 - DNA, 4216 bp, Mus musculus
ctcattcctgccactagcgcgctccgcggctcattccgcggccgccgccagctgaggggagcgtcgcgggccgaggagcagatgccgcgggggccgctcgcagccgccgccgacttgtgaatgggactcggaccggggcccgggctgacaccgctgcgctcgccccgtgccagggacagccggccaggaggtcgtgtccacccgcaacggccccagaaattactgtgctttgtggccctttgaagacattcagttctgttatttattgaatgaccaatcagatgggtggagcatgttataggaattggcagcaggtatccaatgggtgaagaagaagctgactgcggaggtgaccaaccctggcgtgatgtcctcagtgagtgaagatattccattccagaggaggtctacttgacacatctgggaggccgccatccgaaagaaagccactctgttggtgtagggagtgacagctgcattctcctgtgcctactgcataaccaaaaatgaaggagaactactgtttacaagctgccctggtgtgcctgagcatgctataccacagccaggcgtttgctctggagcgacgaagccacctgcatccctctttccatggacaccatgagaagggcaaggaggggcaggtgctgcaacgctccaagagaggctgggtctggaaccaattctttgtgatagaagagtacaccgggcctgaccctgtgctggtgggcaggcttcattctgacattgactccggtgatgggaacattaaatacattctctcaggtgaaggagcgggaaccatttttgtgattgatgacaaatcagggaacattcatgccaccaagacattggaccgagaggagagagcccagtacacactgatggctcaggcggtggacagggacaccaacagaccactggagccaccttcagaattcattgttaaggtccaggacattaatgacaaccctccagagtttctgcatgaaatctatcatgccaatgtgcctgagaggtccaatgtgggaacatcagttatccaagtgacagcctctgatgcagatgatcccacctatggaaatagtgccaagttagtgtatagcatccttgaaggacaaccctatttctcggtggaggcccaaacaggtatcatcaggacagcccttcccaatatggacagagaagccaaggaggagtaccacgtggtgatccaggccaaggacatgggtggacacatgggtggactctcagggacaaccaaagtgacgatcactctgactgatgtcaacgacaacccaccaaagtttccacagagcgtgtaccagatgtctgtatcagaagcagctgtcccgggggaggaagtaggaagggtgaaggctaaagacccagacattggagaaaatggcttagtcacatacaatatcgttgatggagacggcatagaactgtttgaaattacaacagactatgaaacacaggatggtgtggtgaagctgaaaaagcctgtagattttgaaaccaaaagagcttatagcttgaagatagaggccgccaatgttcacattgatccgaagttcatcagcaatggacctttcaaggacactgtgaccgtcaagatttcagtagaagatgccgatgagcctcccatgttcttggccccaagttatatccatgaagttcaagaaaatgcagctgctggcactgtggttgggagagtacatgccaaagacccagatgctgccaacagcccaataaggtattcaattgatcgtcatactgacctcgacaggtttttcacgattaatccagaagatggttttattaaaactacgaaacctctagatagggaagaaactgcctggctcaacatctctgtcttcgcagcagaaattcacaacagacatcaggaaaccaaagtcccagtggccatcagggtcctggatgtcaatgacaatgctcctaagtttgctgccccttatgaaggttttatctgtgagagcgatcaccccaaggcactctccaaccagccaatagttacagttagtgcagatgaccaggacgacacagccaatggaccaagatttatcttcagcctaccccctgaaatcatgcacaacccaaacttcacagtaagagacaacagagataacactgcaggagtatatgcccgacgtggagggttcagtcggcagaagcaggacttctacctcctgcccattgtgatcagtgatggtggcattccacctatgagtagcaccaataccctcactatcaaagtctgtggctgtgatgtgaatggggcactgttgtcctgtaacgctgaagcctacatcctgaatgccggtctgagcactggggcactgatcgccatccttgcctgcatcgtcattcttctggtcatcgttgtgctgtttgttaccctgaggaggcaaaagaaagaaccactcattgtatttgaagaggaggatgtccgtgagaacatcataacctatgatgatgaagggggtggtgaggaagacactgaagccttcgacatagccaccctgcagaatcctgacggcatcaatggatttatccctcgcaaagatatcaaacctgagtatcagtatatgcctagacctgggctgcgaccagcacccaacagtgtggatgtggacgacttcatcaacacaagaatacaggaggcagataatgatcccacagcccctccctatgactccatccaaatctatggttatgagggccggggttccgtggctgggtccctgagctccttggagtctgccacgacagactcagacctggactacgactatctacagaactggggacctcgttttaagaaactggcagacttgtatggctccaaagacacttttgatgatgactcttaacaataatgttacaaatttggccttaagaactgtgtctggcattctcaagaatctagaagatgtgtaaacaggtatttttttaaatcaaggaaaggctcatttaaaacaagcagagttttacagagaggaaacatttaataaaactgcaaggacatcaaagtggaaaatactgtgaagtaccttttcccacttaaaaagcaaatattgaagttgtttatcaacttcagtagaaaaaaaaaaaccacttggcacacaaaatatttaaatgaaggagaagtccacggtgaacttacaatgaagggaaatcgtctatgtgttaagaacatctaagtctctcttattttattttttaatttgtcaaagaagcttccacaaaattagaaaggacaacagttctgagctgtaatttcgccttaaactatggacactctatctgtagtgcgtttttaaacttgaaatatataatatccagccagcttaaacccatacaatgtatgtacaatacaatgtacaattatgtctcttgagcatcaatcttgttactgctgattcttgtaaatctttttgcttctactttcatcctaaactaatacgtgccagatataactgtcttgtttcagtgaggagcaccctatttctatgtcatttttaatgtatctatttgtacaattttaaagttcttattttagtatacatacaaatatcagtattctgacatgtacgaaaatgttacagcatcacacttatattttatgaacattgtactgttgctttaatatgagcttcaatataagaagcaacctttgaaataaaaaaaagattcttttttaattctgggtttgattcttaacattgaaaaaaaataagggtttctaatgatccatttatattcctaatttaattgtgatctttaataaccctatttatgatctgttgtagtctgctgctctcattgtttatttaaatcaaatatgtttgagtttttttaaagataagattctgtaacttcatgtaaatgattttttgtatgttctggcttttcctggagtatatcttctaaagaaggacattagagatctagactagcctatgattagcctatgattttacaatatgttatatattatgcatttaacctgtgaactcatagttatgagagacaaattcatgaggactgccagacctctcgatgttctagatatagacttgatgccctgccttgagcattgtggagttgaaggggtgcagagtcaaagccaactctggttttccttatgtaatttttattaggataaagactgactgacagttgaaagttc

SEQ ID NO: 227 - DNA, 2711 bp, Mus musculus
gaccctttctgttccttctctcggggcggagctcagaaggaatgctaacacaccgtaccagtaggatgggctaagttctcctcctcaagatgatgcccagggcaactatttgggcagcagtttttcattaaacagcagactgagccacagtcttcagtcagtctcctcgtggatgtcactgagtgcaaggaggcttcaggactctacttctgacctacagagtcaaaattccttagagcagaacatctggccctaatgtgcaggagcagctgtttagtacctgcgatgtaaacaaagcactctcatcttggctgccgctgttccccatcccggaggcagagtaccatcaggatcggcttgtctcctgatgggaagaagagaaaacgggcagttccaacagggcaaggatgcttgtgtgatgacttaccatgtgccaggtgctgtggatctgttgtgtgaacgtcttccagggaatagtaagcaaatacctgttcttgcctcccgccaggtaggccattaacaacaggccgaagtatgatttcagcaaagtttagcttggcaaatcaaaaagtatattatagggcttccctagagagcatgggtaaccccaaagcagctggataagcaaagaataaacacaaaaaaccaaccaaccaactgaaaactcacccgaagttgggtgagggcttctccttagctacatagttacagtctctacttcaaagagctcccaccttcgatacactgtcgcacctcttggaaaccaagcaaccgcatgcagcttggacagaattacatgtaaggaggaggaaagtctagcaggaaccaggctagaatctcaagtcagggtcagacaattcttcccaccctctttttctgtaagggaaagtcaaaggttaaacaagccccagtttgagagtctcccccaagtagtcatggctaactctgatgaagatgcttgccgttatgcctgcaggatagcattgtgggacacaagtgcttccatacagctgagcgccaatgagtttactgggtgtcactcacagagtttgtctgatctcaccccagcctgcatggtgacttctctgtagctgcatgggtggaggcactgcacagaagaccgctcatcttcctgtgtgacttcagaggtgtttatttgggtgtgggtgcaaaggcgcagaagtagagactgcatctgccggaggcacagtgcatgcagctttatctaagactgagatgaatgttgcaacctgaaaacaacttgcctacaacggagaaacgaacagagctcttacagctcgctgagttacgcatcaagaggtccagaaggatttgtttggatgagatttttgaggtcatgtttcaccatgggcaagacaacgatgtttgctgctatgtgaaggtgctcctggtcacgtctgcagatgatctggagtgcacccctggattccagcggaaagtgttacacatccaccagcctgccgaattcatcgaggaccagcctgtcctaaacttgaccttcaatgactgcaagggcaacgagaagctgcactacgaggtctcaagcccacacttcaaggtgaacagcgacggcaccttagtggctctcaggaacatcactgcggtgggcaggaccctgtttgtccatgcgaggactcctcatgctgaagacatggcagaactcgtgattgtcgggggcaaagacatccagggctccttgcaggatatctttaaatttgcaaggacatctcctgtcccaagacaaaagaggtccattgtggtgtcccccatcttgatcccagagaaccagagacagcccttccccagagatgtcggcaaggttactccgagatacagtggtcctgcggttaacaatgagattacattatttcctcactgtattgaaatattcagcaactaatttcctggagcttcataataaatcacattaatgacctaagaggtggaaatcaaggtggcgagaccggctccatgctttagggttactctacccaacaaagcagaaggtagtcgatagcgacagacccgaagggtccaagttccggctcaccgggaagggagtggatcaagaccctaaaggaactttcagaatcaatgagaacacaggcagtgtctccgtgacacggaccctggacagagaaacgatcgctacttatcaagtacccaggaggctgaggcagaaaggatcacaggtggaaggccagttagagtcacggagtgaatctaaaaccagtctggacaatccaatgagatcctgtctcaaataacaacttagaaagaaggcaggagatacagttcagtggtagaggcgcctgcctagcatgtgtggacactgttcagttggaaagaaggaagacatcaacacgggacccaggttccttagcctctttcctaggacctatctgaatggggctgagagagggtctgaccgactgtgggatcaatgactcttaagttccatcccgttctgcgactgactggcaccctacacagtccccggccccagtgcccagaagggcttcctgtggttctgacctgaagtggcacctggcaagatcatttagctcttgcagtcttgggagctgacatattaatgtaaagcctcgtgaaatgtcactcattattatgcgttttgccagtgtttgagtgatttgtgaactcctcattggaataaagtactgtaaatgact

SEQ ID NO: 228 - DNA, 756 bp, Mus musculus
  modified_base (675)..(675): a, c, g, t, unknown or other
ttttttttttttttttttaatgaacaacttttttattctcagctttgcgaacaacggtagtcacacggaagggtacttgaaaaactacctgggcttactctattttatgcctgtatataggaaacaaacggtgcggatatgcgtaatgcgtgtgtacatgtgtgggtaatagatgtgcatacaagatggtgctgttggtctcctcataggtacaccatgatgacatttgtacttgtacatacaccgaggagggagagggccaccaccatgatctgtgtcaccacaaggaccataggactgtgggtctggggtggtacagtggcagacttgcccatgggagaatagttcagcccttagcctctgatggcaagatgccttgctccactcttgggcataaggacatcaagccatggcatctggtggtactggggcgtggtggcagtcctactaagcagagaagacttcttccccttgcccttcccccacccccaacctctggacctgcctagctggttggtcagcattcagtgtttagactgagcaggcccttgctatacacgtgagtgacagacagcttactggactgaccttgactggagggcggagctgtctgagcgtccacatcctctgtctaaccatctccaaagcaggtatctcctgcagtcttctacacanatactgggtctatacacagacagatacccatacagggacagataggaaccaccacacagatgcgtgggcggagcactggct

SEQ ID NO: 229 - DNA, 1301 bp, Mus musculus
ttcccaggcgctagcgctcgagcgttcccaggacgctcaccgaagctactgggtctccagaggggaggagccgctcagagaccaggctgtagcaatctcacggccggcgaaggaccatttctgccacagaccggggacaagggcatgttgggcggcagcagtgacgcgggcctggccaccgccgcggcgcgggggcaagtggagacggtgcggcagctcctggaagccggcgcagatcccaacgccctgaaccgcttcgggaggcgcccaatccaggtcatgatgatgggcagcgcccaggtggcagagctgctgctgctccacggagcagaacccaactgcgccgaccctgccacccttaccagacctgtgcacgacgcagctcgggaaggcttcctggacacgcttgtcgtgctgcaccgggcaggggcgcggctggatgtgtgtgacgcctggggccgcctgccggtagacttggctgaagagcagggccaccgtgacattgcgaggtatctgcacgctgccactggagattgactgcgggttccctccgccttccgcaaggacttctttctccccagccccatctaggaagactgtaagcacgaagaggccaccagcgcccagcctgcaggccttccaaaacttgaaccctacccagtaagacaaagccaatcagaaataacttcctacgcattttctgcagctggatctggtccttgagcctcaccttgaagccaaggggatcaccaaggagatttagtattgtatgaagttcccgggccctctacctttcaggacgtggtgtcccctagcaagggaaattcttggatctccacaagctgctgctgcaggggaactggagacagcttgacatttgtttgacatttgggtgggtgcagtcagtaccttcccctgtgaactgaaaatgcagatgatccacaggctaaatgggaaacctggagagtagatgagaggcactgaagtggttttatgtactgtcatgtgtggggattcacctgcaaaatggcatttatagaaactgagaagtcacctccagctcgacaaggaaatagtgaaattgaagacaataaatttccactaaactgtgacccacagttgccttgatgcctggattctgacagactcaacgtccacaaagcccagtgatgaattgtagtggtagcaggttactctatgcaaaatagtttaataaccactttagaaatttcctacatttgagttgctctttaataacagtgtatttaaagaaaaaaaaatttaaagaaacagtgaagttc

SEQ ID NO: 230 - DNA, 814 bp, Mus musculus
ggattaacgaggaggaccacctgcgagtcatctccatgcagaaggggggcaacatgaaggaagtgttcacccgattctgcaccggcctcactcagatcgaaactctcttcaagtccaagaactatgagttcatgtggaatcctcacctgggctacatcctcacatgcccatccaacctgggcaccggactgcgggcaggtgtgcacatcaagctgccccacctggggaagcacgagaagttctcggaggtgctcaagcggctgcggcttcagaagcgaggcacaggtggcgtggacaccgctgctgtcggtggggtgtttgatgtctccaacgctgaccgcctgggcttctcggaggtggaactggtgcagatggtggtggacggagtgaaactactcattgagatggagcaacggctcgagcagggtcaggcaatcgatgacctcatgccggcccagaagtgaagcctggccctcgccaccatcaggctgccgcttcctaacttattacccgggcagtgcccgccatgcatccttgatgtttgccgcctggcggctgagcccttagcctcgctgtagagacttctgtcgccctgggtagagtcacttctgatggctaagctgttgctgacacttgagaataaactagggtttggcctgccctagaacacaccacacaaagacagtcaacaaacgtgggcgtggtcgcttacaaataccccgcaaggcgcccagtttgtgcgctccgcaggttctgcgcacaaggcggcccataaggcaccaggttcttaacctcaggctggccggtataaaac

SEQ ID NO: 231 - DNA, 1646 bp, Mus musculus
ttcggccttagctgtccgcgcccagtgacgcgcgtgaggacccgagccccaatctgcaccccgcagactcgcccccgccccataccggcgttgcagtcaccgcccgttgcgcgccacccccatgcccgcgggtcgcccgggccccgtcgcccaatccgcgcggcggccgccgcggccgctgtcctcgctgtggtcgcctctgttgctctgtgtcctcggggtgcctcggggcggatcgggagcccacacagctgtaatcagcccccaggaccccacccttctcatcggctcctccctgcaagctacctgctctatacatggagacacacctggggccaccgctgaggggctctactggaccctcaatggtcgccgcctgccctctgagctgtcccgcctccttaacacctccaccctggccctggccctggctaaccttaatgggtccaggcagcagtcaggagacaatctggtgtgtcacgcccgagacggcagcattctggctggctcctgcctctatgttggcttgccccctgagaagccttttaacatcagctgctggtcccggaacatgaaggatctcacgtgccgctggacaccgggtgcacacggggagacattcttacataccaactactccctcaagtacaagctgaggtggtacggtcaggataacacatgtgaggagtaccacactgtgggccctcactcatgccatatccccaaggacctggccctcttcactccctatgagatctgggtggaagccaccaatcgcctaggctcagcaagatctgatgtcctcacactggatgtcctggacgtggtgaccacggaccccccacccgacgtgcacgtgagccgcgttgggggcctggaggaccagctgagtgtgcgctgggtctcaccaccagctctcaaggatttcctcttccaagccaagtaccagatccgctaccgcgtggaggacagcgtggactggaaggtggtggatgacgtcagcaaccagacctcctgccgtctcgcgggcctgaagcccggcaccgtttacttcgtccaagtgcgttgtaacccattcgggatctatgggtcgaaaaaggcgggaatctggagcgagtggagccaccccaccgctgcctccacccctcgaagtgagcgcccgggcccgggcggcggggtgtgcgagccgcggggcggcgagcccagctcgggcccggtgcggcgcgagctcaagcagttcctcggctggctcaagaagcacgcatactgctcgaaccttagtttccgcctgtacgaccagtggcgtgcttggatgcagaagtcacacaagacccgaaaccaggacgaggggatcctgccctcgggcagacggggtgcggcgagaggtcctgccggctaaactctaaggataggccatcctcctgctgggtcagacctggaggctcacctgaattggagcccctctgtaccatctgggcaacaaagaaacctaccagaggctggggcacaatgagctcccacaaccacagctttggtccacatgatggtcacacttggatataccccagtgtgggtagggttggggtattgcagggcctcccaagagtctctttaaataaataaaggagttgttcaggtcccgatgg

SEQ ID NO: 232 - DNA, 1185 bp, Mus musculus
cctagatcagctcagggttccagtcagacacctagttctgctctcctctaggactccacaaagagttaatgtccctggggctaagcctaggaagattccagtccctgcccaggcccaagatagttgctggctcaattcccctggcatgcgagactggagaggaggaggggcccaccagcagctgcttgggattccaggctccatcctagctccagagaacaaggatggggtgggtgccactgggtgtggacagagagctagtgaaacaagaccatgacaagtcaccggtcagctcagccctgcctgtgtttctcttttcttagctcagtgagtaccgggtatgtgtcaccctgccaaatccctgatcacaagtctccatgaactggcggtgagctgggataataaaacccctgacctcaccattccagaagcttcagaagactgcatatataaggggccggctggagctgctgctgaaggagttgaccagccaaccgactctgcattcatctagccacaatggacatcgccatccaccacccctggatccggcgccccttcttccccttccactccccaagccgcctcttcgaccagttcttcggagagcacctgttggagtctgacctcttctcaacagccacttccctgagccccttctaccttcggccaccctccttcctgcgggcacccagctggattgacaccggactctcagagatgcgtttggagaaggacagattctctgtgaatctggacgtgaagcacttctctccggaggaactcaaagtcaaggttctgggggacgtgattgaggtccacggcaagcacgaagaacgccaggacgaacatggcttcatctccagggagttccacaggaagtaccggatcccagccgatgtggatcctctcaccatcacttcatccctgtcatctgatggagtcctcactgtgaatggaccaaggaaacaggtgtctggccctgagcgcaccattcccatcacccgtgaagagaagcctgctgtcgccgcagcccctaagaagtagatcccctttcctcattgagttttttttaaaacaaggaagtttcccatcagtgattgaaaatctgtgactagtgctgaagcttattaatgctaagggctggcccagattattaagctaataaaaatatcattcagcaac

SEQ ID NO: 233 - DNA, 226 bp, Mus musculus
tcaatggaccaagagacacgtgtctggccctcagagcaccattcccattacctgtgaagagaagcctgctgttgccgcagcccctaagaagtagatcccctttcctcattgagttttttttaaaacaaggaagtttcccatcagtgattgaaaatctgtgactagtgctgaagcttattaatgctaagggctggcccagattattaagctaataaaaatatcattc

SEQ ID NO: 234 - DNA, 4426 bp, Mus musculus
gccgatcggggctgcgcggggagccgggcatgggggccgccctccgggggggccggggccgccgccgccgccgccgcggcagcgactgaagccgcgctgtaaggaggggcggggagtggccgccgccgtccccgggaggcgccggagcccgaccgcactcgcagccagccagccgtcccgagctgctcgcagattcactgaaaacaccctgcaagtaccacgtgcctacaactgctgccagcttcccaggccacagctgtggggagcttggggtacagcagactcgtttctgtattcagctgcccaggcagaggagaatggggtctccacagcctgaagaatgaagacacgacagaataaagactcgatgtcaatgaggagtggacggaagaaagaggcccccgggccccgggaagagctgagatcaaggggccgggcctcccctggaggggtcagcacatccagcagtgatggcaaagctgagaagtccaggcagacagccaagaaggcccggatagaggagccctctgccccaaaggccagcaagcagggccggagcgaggagatctcagagagtgagagcgaggagaccagtgcgcccaaaaagaccaaaaccgagcaggagctccctcgcccgcagtctccctcggatctggacagcttggatgggcgcagcattaacgatgacggcagcagcgaccctagagatatagaccaggacaaccgaagcacatcccccagcatctacagcccgggcagcgtggaaaatgactcggactcatcctctggcctgtcccagggccccgcccgcccctaccacccacctccactcttccctccttcccctccaccaccagacagcactccccgacagccagagtctggctttgaacctcatccttctgtgccgcctactggatatcatgctccgatggagccccccacatcgagattattccagggcccaccacctggagctcctcccacacacccacagctctaccctgggaatgctagtggaggtgttttatctggaccccccatgggtcccaaagggggagccgctgcctcctcagtgggtgcccctagcggaggcaagcaacaccccccacccactaccccaattccaatatcaagttctggggccagtggtgctcctccagcaaagccacccagtgctccagtgggtggtgggagcttaccttctgcaccaccaccagcttctttcccccatgtgacaccaaacctgcctcctccacctgccctgagacccctcaacaatgcctcagcctctcctcctggcatgggggctcagccaatccctgggcatctgccctctccccatgccatggggcagggcatgagtggacttcctcctggcccagagaagggtccaaccctggccccttctccccaccctttgcccccagcttcttcctctgcccctgggcctccaatgcgatatccatattcatcctccagtagctctgccgcagcctcttctagttcctcctcctcctctgcctcccagtaccctgcttcccaggccctgcccagttatcctcattccttccccccaccaactagtatgtctgtctctaatcagccacccaagtacacccagccttctctcccatcccaagctgtgtggagccagggtccacctcctcctcctccctatggccgcctcttggccaacaacaacacccatccaggccctttccctcctactgggggtcaatctacagcccacccagcagcccctacacatcaccatcaccagcagcagccacagcaacaacatcatcatggaaactctgggccccctccacccggagcgtatcctcaccctctagagagcagtaactcccatcatgcacacccttacaacatgtcaccctccctggggtctttaaggccctaccccccagggccagcacacctgcctccacctcatggccaggtgtcctataaccaagcaggtcccaatggtcccccagtttcttcttccaactcttccgggtcttcctctcaagcctcctattcatgttcacacccctcttcatcccagggcccccaaggagcatcctaccccttcccaccagtccctccagtcaccacctcctcagctaccctttccactgtcatcgccaccgtggcttcctcgccagcaggctacaaaacagcttcgccacctgggccccctcagtacagcaagagagccccatccccagggtcctacaagacagccaccccgcctggatacaaaccggggtcaccaccctccttcagaacagggaccccacccggctatcgaggcacctctccgccagcaggcccagggaccttcaaaccaggttcaccgaccgtggggccggggcccctgccacccgcggggccttcaagtttgtcatctctgcctccgccacctgcggccccgactacagggccgcccctgaccgccacgcagatcaaacaggagccggcggaagagtatgaacctcccgagagtccggtgcctccggcccgcagcccctcgccccctcccaaggtggtggacgtgcccagccatgccagccagtcagccaggttcaataagcacttggaccgcggcttcaactcgtgcgcgcgcagcgacctgtacttcgtgccgctggagggctccaagctggccaagaagcgcgcggacctggtggagaaagtgcggcgcgaggccgagcagcgcgcgcgcgaggagaaagagcgcgagcgcgagcgggaacgcgaaaaggagcgcgagcgcgagaaagagcgcgagctggagcgcagtgtgaaactggcccaggagggccgtgctccagtggagtgcccatctctgggtccagtgccccatcggcctccctttgagcctggcagcgctgtggctacagtgcccccttacctgggtcctgatactccggccttgcgcactctcagtgaatacgcccgacctcatgtcatgtctcctggcaatcgcaaccacccattctatgtgcccttgggggcagtggacccggggcttctgggttacaatgtcccagccctgtacagcagcgacccagctgcccgagaacgggagcgggaagcccgtgaacgtgacctccgtgaccggctcaagcctggctttgaggtgaaacctagtgagctggaacccctacatggggttcccgggccaggcctggatcccttcccccgacacgggggcctggctctacagcccgggccacctggcctgcatcctttcccttttcatccgagcctggggcccctggaacgagaacggctagcgctggcagctgggccagccttgcgtcctgacatgtcttatgctgagcggttggcagctgaaaggcagcatgcagaaagggtggcagccctgggcaatgatccactagcccggctgcagatgctcaacgtgactccccatcaccaccagcactcccacatccactctcaccttcacctgcaccagcaggatgctatccacgcagcctctgcctcggtgcaccctctcattgaccccctggcctcagggtctcaccttacccggatcccctacccagctgggaccctccccaacccccttcttcctcaccctctgcacgagaacgaagttcttcgtcaccagctttttgctgccccttaccgggacctgccggcctccctttctgctccaatgtcagcggctcatcagctgcaggccatgcacgcgcagtcagctgagctgcagcgcttggcgctggaacagcagcagtggctacatgctcatcacccattgcacagcgtgccactacctgcccaggaagactactacagtcacctgaagaaggagagtgacaagccgctgtagagctgcgatccagacagcacccactgctccttcatccagaccttggaggaccaccccaaccttttgaccccaccccacccccagccgaggagagggtgctgcccgcttgcagagctcctgcagctgggtagagggagggagggaagaagggacagacaaggtcagggcccggggttgtgtgcagaggtgggaagtggcaagggtgggggcagaaagtgcacagtatcttggaccaggtccctcctcctatcccctgcttttcttctcctctatgccgaatccttggtggccactgcccctcccctaacccattggtgtgatttttttcatctgttagatgtggctgttttgcgtagcattgtgtgctgccccgccccatccctgtgtgtgcaccccctccctcggcgatatgtgcccttacccgtcccacattaataatttatatatataaatatctatatgatgctctttaaaaaacatcctgaccaaaaccaaccaaacaaaaacatcctcacagttccccaggaaaaaaaaaaaaaaaaaaaaaaaaaaaaaaaa

SEQ ID NO: 235 - DNA, 627 bp, Mus musculus
cattatttaaaattctcacacaaaatttggtcagttcaaaggtggaaggaggaatcaaatatcctttaatattttttcttcctccttctggaatatgcatgtcactgcatgataactctgacttttcctttgttttaataaaactgttctcagacatttaagctaaactaagagaaaaaaaaaactttgttgccaaaaggttgtgctatcccgatttttttatatgtctgcatgtttaaaaaacaaaagaaaatgcactctaacttatgtgaactgagagaaaaaatcaggttttaaacaggaaaacctatggggaatgatattttttgaaagacttttgtatacagttgagtacttagaaaaagacaaaccagatgtaatatattttgtggatgtttttatttcttggatttatagtaccttatactaaggttaaaaaaatgcttgatattgtgaaaaggtgaggtttttcaccaacatttcatttacttcttgtcacattgttatgccaatataatatagttaatgaaaacagcatttttaaaagccaaatattgaagccggtgtaatgttgccccatttgccttgtgagcaaatgccaatacagtaaatatattgtgtttgctg

SEQ ID NO: 236 - DNA, 1506 bp, Mus musculus
taaaagggcaagggatttctagttccttaagggatcaactgtccactcttgctcactcacatctcctgtggtgcagccatggccatgcaaaaaatcttcgcccgggaaatcctggactccaggggcaaccccacggtggaggtggacctgcacacagccaagggtcgattccgagcagctgtgcccagtggagcttccacgggtatctatgaagcactggaactccgagatggagacaaagcacgatacctggggaaaggagtgctgaaggctgtggaacacatcaacaagactctaggtcctgctctgctggaaaagaaactaagtgttgtggatcaagaaaaagttgacaagttcatgattgagctggacgggaccgagaataagtccaagtttggggccaacgccatcctgggtgtgtccctggctgtctgcaaggctggagcagctgagaaaggggtccctctctaccgacacatcgcagatcttgcaggcaatcccgacctcgtactccctgtgcctgcctttaatgtgatcaacggcggctctcatgctggaaacaagctggccatgcaggagttcatgattctgccagtgggagccagctctttcaaggaagccatgcgcatcggcgctgaggtctaccaccacctcaagggggtcatcaaggccaagtatgggaaggacgccaccaacgtgggggatgagggtggctttgcacccaacatcctggagaacaatgaggccctggagctgctaaagacagccatccaggcagccggttacccggacaaggtggtgatcggcatggatgtagctgcgtctgaattctaccgcaacggcaagtatgatctggacttcaagtcacccgatgaccctgccaggcacatcagtggggagaagcttggggagctgtacaagaacttcatccagaactatcccgtggtctccattgaggacccctttgaccaggatgactgggccacatggacctcattcctctctggggtggacatccagattgtgggagatgacctcacggtaaccaaccccaagaggattgctcaggctgtggagaagaaggcctgcaattgcctgctcctgaaggtcaaccagatcggctccgtgacggagtccatccaggcctgtaaacttgcacaatctaatggctggggagtgatggtgagccaccgctctggggagaccgaagacactttcatcgctgaccttgtggtgggactctgcacaggacagatcaagactggtgctccctgccgttcagagcgtctggcaaaatacaaccagcttatgaggattgaggaggctcttggggacaaagctgtctttgctggaagaaagttccgtaatccaaaggccaaatgaggagctggagactccaggctttcacaggaaagacacaggccttcaagcccttctcccagaaataaacactgccaaaccagaaaaaaaaaaaaaaaaaaaaaaaaaaaaaaaaaaaaaaaaaaa

SEQ ID NO: 237 - DNA, 1708 bp, Mus musculus
aggagtttgagagtggaggaactgcacaccagccgccgcgggagtaggaacccgagagcgaccctgacagagtcatgtggctggaactcatcctggcttctgtgctgggctttgtcatctactggtttgtctcccgggacaaggaggagaccttaccacttgaagatgggtggtggggcccagggtcaaagccatcagccaaagaagatgagagcatccggcccttcaaggtggaaacatcagatgaggagatcaaggacttgcaccagaggatagataggttccgggcatccccacctttggagggcagtcgcttccactatggcttcaactccagctacctgaagaaagtggtgtccttctggaggaatgagtttgactggaggaagcaggtggagatcctcaaccaatacccacactttaagaccaagattgaagggctggacatccacttcatccacgtgaaacctccccagctgccctcaggccgcactccaaagcccttgctgatggtgcacggctggcctggctccttctatgagttctacaagattatcccactgctgacagaccccaagacccacggcctgagtgatgagcacgtgtttgaagtcatctgtccctcaattcctggctatggcttctcagaggcatccagcaagaaaggtttaaattcggtggccactgcgaggatcttctacaagctgatgtcacggctgggcttccagaagttctacattcaaggcggcgactgggggtctctcatctgcaccaacatagcccagatggtgcccaaccacgtgaaaggtttgcacttgaatatgtctttcatttcaagaaacatttattccctgacccctctcctgggccaacgttttgggagatttcttggctacacagagaaggatctggagctcttgtacccattcaaggaaaaggttttctacaacatcatgagggagagtggctacttacacatccaggccaccaagccggacactgtgggctgtgctctgaatgactctcctgtgggcctggctgcctacatcttagagaagttctccacctggaccaagtcagaataccgtgaactggaggatggaggcctggagaggaagttctccctggaagatctgctgactaacatcatgatctactggacgacaggaaccattgtctcctcccagcgcttctacaaggaaaacttgggccagggtgtcatggtccatagacatgaggggatgaaggtctttgtgcccactggctattcagccttcccttctgagatcctgcatgccccagaaaagtgggtgaaggtcaagtaccccaaactcatctcctattcctacatggaacgtgggggccactttgctgccttcgaagagcccaagcttctggcccaggacatccgcaagttcgtgtccctggctgagctgcagtgatgacgctacacaccaaccatggctttagcagcagccctggttccttcccagtcatacttatggaagatgtgcccttccagaggaataagtttgttccctgaccacactgggggacccagacttcaaccccacagagtcctctcttaccacccccatatgcttcgccccactgcatagctgtgttaagctacatggctttaatgataaatgggtttatttctaaaaaaaaaaaaaaaaaaaaaaaaaaaaaaaaaaaaaaaaaaaaa

SEQ ID NO: 238 - DNA, 1503 bp, Mus musculus
ttgtcatcccattgccagctggacaagtcagtctttgctttccccgtgacatgtagttgagttgcagcggaaaggaaatgtgtcatctgtggtttggttttaagagtggaaagctagctgtacatatcctctttaaaaaaccctgcagatttaagtttcacagtctccaaagtattctacttaaaataagaagagcagaactgaggtggcttacgaagtgacggctgggcgagctctgaagatagcagtggacctgtaggtatggagcacaaaggacagtacctgcatcttgttttcctgatgacaacagtgtgggcctcgtcgtcttctggaacaagaccaaactacacacacctgtgggctagcagtgtcactgcctcaggttccagtaatcagaatggctccagcagacatccgagtgacaataacacaaaccttgtcactcctgccgtgggtcacaaggtgagcgccacagacaagcctgcatcatctccccctgtgcctttagcttccacatctacactcaagtcctccacgccccatgccttcagaaacagttctccaacagcagagatcaaaagtcagggggaaacgtttaaaaaggaagtctgtgaggagaacaccagcaacacggccatgctaatttgcttaattgtaattgcagtgcttttccttatctgtacctttctatttctatcaactgtggttctggcaaacaaagtctcatctctcaaaaggtcaaagcaagtaggcaagcgccagccgcggagcaacggtgactttctggcaagtagtgggctctggactgctgagtcggacacttggaaaagagcaaaggagctcacaggctccaacctcctattgcaatctcctggtgtgcttacagcagccagggagagaaagcacgaagaaggaactgaaaaactcaactaggctgtgggttggaaagggaaatgcaaagcagcaatgaggaaggcagagttagaaataaagctggctggtggtatttcccatccacgtttgctcagatgatccaaagtctgacatgctctttgtttagcgtcagaccagaaagggagatgtatgcttgctcaaggtttatatctgtttcgtacttcatatttttaagaaagtaaaacaacagcagctaaagaaactaatagaaataacatgaggtaattaaacattcctgttcagcagtgaatgacctctgtctgaatgtacttgaacttggaagagttcttttaagcccttagagccaagcagatgtcaaattcccaatgtgtagaattcaactatgtaacgcaatggtacattctcactggatgagatagaacctgtaccagttgctatcttagtacagctaatattaggctacatctttttacctttacatatggcgtaagacaagactgcttttctattatacataacacattaaaacttaattttgtacaataaatgaaaacagactttagaacaaaaaaaaaaaaaaaaaaaaaa

SEQ ID NO: 239 - DNA, 1303 bp, Mus musculus
ccgccactccgggtcaccctgtcggaatggggatgccactgccctgggccctcagcctcttgttggtcctcctgcctcagacctggggctcagagacccgccccccactgatgtatcatctcacggctgtgtcaaacccatctacggggcttccctctttctgggctacaggctggttgggtcctcagcagtatctgacctacaacagcctgcggcaggaagctgacccctgtggggcctgggtgtgggaaaatcaggtgtcttggtattgggagaaggagaccacagacctcaaaagcaaagaacagctcttcttggaggccctcaagaccctggagaagatattaaatgggacctacacactgcagggcctgctgggctgtgaactggcctcggataattcctcagtgcccacggctgtgtttgccctcaatggtgaggagtttatgaaattcaacccaagaatcggcaattggactggggagtggcctgagacggaaatcgttgctaatctgtggatgaagcagcctgatgcggccaggaaggagagcgagttcctgctaaactcttgtccggagcgactgctaggccacctggagaggggccgacggaacctggagtggaaggagccgccgtctatgcgcctgaaggcccgtcctggcaactctggctcctccgtgctgacctgtgctgctttctccttctacccaccggagctcaagtttcgattcctgcgcaatgggctagcctcaggctccgggaattgcagcactggtccgaatggagatggctctttccacgcatggtcattgctggaggttaaacgtggagatgagcaccattatcaatgtcaagtggagcatgaggggctggcacagcctctcactgtggacctagattcatcagccagatcttctgtgcctgtggttggaatcgttcttggtttattgctggtggtagtggccatcgcaggcggtgtgctgttgtggggcaggatgcgcagcggtctgccagccccatggctttctctcagcggcgatgactctggtgacctgttgcctggtgggaacttgcccccagaagctgaacctcaaggtgcaaatgcctttccagccacttcctgatgcagactcgggccccctgcccactgcagcctttcgggctgtgtgacctcctgaactgtctccgagcctcctgagggagcctgggccgatgtcctccatggatccctgctttgtggcctgcttcagtttcccttcttaatgtacatggttgttttccatctccacataaatttggcccc

SEQ ID NO: 240 - DNA, 2983 bp, Mus musculus
gaattccggagccttgttaccaacctctaaccgcagaactgggatgtggggctggaagtgcctcctcttctgggctgtgctggtcacagccactctctgcactgccaggccagccccaaccttgcccgaacaagatgcactcccatcctcggaagatgatgacgacgacgatgactcctcctcggaggagaaagagacggacaacaccaaaccaaaccgtaggcctgtagctccctactggacatccccagagaaaatggagaagaaactgcatgcggtgcccgctgccaagacggtgaagttcaagtgcccgtcgagtgggacacccaaccccactctgcgctggttgaaaaatggcaaagagtttaagcctgaccaccgaattggaggctacaaggttcgctatgccacctggagcatcataatggattctgtggtgccttctgacaagggcaactactcctgcatcgtggagaatgagtatgggagcatcaaccacacctaccagcttgacgtcgtggaacgatctccgcaccgacccatccttcaggcagggctgcctgcaaacaagacagtggccctggcgagcaatgtggagttcatgtgtaaggtgtacagcgatccgcagcctcacattcagtggctgaagcacatcgaggtgaacgggagtaagatcgggccagacaacttgccgtatgtccagatcctgaagactgctggagttaataccaccgacaaggaaatggaggtgcttcacctacggaatgtctcgtttgaggatgcgggggagtatacgtgcttggcgggtaactctatcggactctcccatcactctgcatggttgaccgttctggaagccctggaagagagaccagctgtgatgacctcaccgctctacctggagatcattatctactgcaccggggccttcctgatctcctgcatgttgggctctgtcatcatctataagatgaagagcggcaccaagaagagcgacttccatagccagatggctgtgcacaagctggccaagagcatccctctgcgcagacaggtaacagtgtcagctgactccagtgcatccatgaactctggggttctcctggttcggccctcacggctctcctccagcgggacccccatgctggctggagtctccgaatatgagctccctgaggatccccgctgggagctgccacgagacagactggtcttaggcaaaccacttggcgagggctgcttcgggcaggtggtgttggctgaggccatcgggctggataaggacaaacccaaccgtgtgaccaaagtggccgtgaagatgttgaagtccgacgcaacggagaaagacctgtcggatctgatctcggagatggagatgatgaaaatgattgggaagcacaagaatatgatcaaccttctgggagcgtgcacacaggatggtcctctttatgtcattgtggagtacgcctccaaaggcaatctccgggagtatctacaggcccggaggcctcctgggctggagtactgctataaccccagccacaaccccgaggaacagctgtcttccaaagatctggtatcctgtgcctatcaggtggctcggggcatggagtatcttgcctctaagaagtgtatacaccgagacctggctgctaggaacgtcctggtgaccgaggataacgtaatgaagatcgcagactttggcttagctcgagacattcatcatatcgactactacaagaaaaccaccaacggccggctgcctgtgaagtggatggcccctgaggcgttgtttgaccggatctacacacaccagagcgatgtgtggtcttttggagtgctcttgtgggagatcttcactctgggtggctccccataccccggtgtgcctgtggaggaacttttcaagctgctgaaggagggtcatcgaatggacaagcccagtaactgtaccaatgagctgtacatgatgatgcgggactgctggcatgcagtgccctctcagagacctacgttcaagcagttggtggaagacctggaccgcattgtggccttgacctccaaccaggattatctggacctgtccataccgctggaccagtactcacccagctttcccgacacacggagctccacctgctcctcaggggaggactctgtcttctctcatgagccgttacctgaggagccctgtctgcctcgacaccccacccagcttgccaacagtggactcaaacggcgctgactaccaaccctgtcccagttttctcccattccgtcgtcacccgtgccctcacccacaaatcccctgttggacacactgccttctcctcctccttgccgctggcaagagccagtgcctgactgaaggccttcctgtgttgtggccttccccctccatcacccccaagacccctcttctccctcttcttagcctgctgtgtgagagaggagccaagaggcaggtgcttgccgacggccgcatcctccttcccaggtgttggaccaagacccgccccgctgctggcactgcttggaggtgtgcagagcggaagcaagtggagacgtatccggggcattcctgttgacccatcagccccttctgttctggcggcagggccttggggctcctggaagccgtgaggtttctgtttaggccttaaccgaaggcaacctctgctccagatggatggtaccagtagcttcttaattccaatactaatttgctttgctgaccaaatacctgcctggtaccagaagacagggaggcagagactgggagccgtgatgtgcccttggctgagcctagacttggggctctgtacatagctatgaagaaaaacacaaagtgtataaatcttgagatatatttacatgtctttttaaaaagggtcgttactagagatttaccatgggggagacgcccagggtagcatccgttgctatatattaaaaacacaaacgaacaaaaaaaaaagaattc

SEQ ID NO: 241 - DNA, 866 bp, Mus musculus
  modified_base (777)..(777): a, c, g, t, unknown or other
gcctgctgacactctgtggggcttacactgggcctgggagtgctgctttgggaaacatgaatctcctattcagactagcagttttccttagcctgtggtgttgttccgatgctcagggacaaacaaaagaagaaagcactgaggaagtgaaaatagaagttttgcaccgtccagaaaactgctccaaaacaagcaggaaaggagacttgctaaatgcccattacgatggctacttggctaaagacggctccaaattctactgcagccggacacaagatgaaggccaccccaaatggtttgttcttggtgtcggacatgtcataaaggggctggacattgctatgatggacatgtgccctggggaaaagagaaaggtgattatacctccttcatttgcatatggaaaagaaggctatgcagaaggcaagattccacccaatgcaactctgatgtttgagattgaactttatgctgtgaccaaaggaccaaggagcattgaaacatttaagcaaatagacacggataatgaccggcaactctccaaagctgagatagagctttacttacagaaggactttgaaaaagatgcaaacccccgtgacaagtcatatcagaaggcagttttggaagatatctttaagaaaaatgaccacaatggagacggcttcatttctcctaaggaatacaatgtgcaccaacatgatgagctataaatataattacttctctatttgttagtaactcacatactttgcttttaaaaaaataccaccgttntctatgttgtggttatacctgttttcccttgtgagaagatatttgttccttcaataaacataattttggtgtattaatgtaaaaaaaaa

SEQ ID NO: 242 - DNA, 729 bp, Mus musculus
  modified_base (8)..(8): a, c, g, t, unknown or other
  modified_base (21)..(21): a, c, g, t, unknown or other
  modified_base (27)..(27): a, c, g, t, unknown or other
  modified_base (33)..(33): a, c, g, t, unknown or other
  modified_base (76)..(76): a, c, g, t, unknown or other
  modified_base (186)..(186): a, c, g, t, unknown or other
  modified_base (232)..(232): a, c, g, t, unknown or other
tttgaccntaggggaggaccntaaccntgtttngggaaacaaacccagggctgggggcccttcaagaacttggcangcatccaaattttggccttcccagttcttcacctttttcccagagatgtagcaaaaaccaaaccaaaacaaaacaaaaaaccgcatggagtgtgttgttcctaggacacntgagagctggtagttagtagagcatgtgagtcaaggcctggtcggngtctcttttctctttctcccttagttttctcatagcactaactaatctgttgggttcattattggaattaacctggtgctggattgtatctagtgcagctgattttaacaatacctactgtgttcctggcaatagcgtgttccaattagaaacgaccaatattaaactaagaaaagataggactttattttccagtagatagaaatcaatagctatatccatgtactgtagtccttcagcgtcaatgttcattgtcatgttactgatcatgcattgtcgaggtggtctgaatgttctgacattaacagttttccatgaaaacgtttttattgtgttttcaatttatttattaagatggattctcagatatttatatttttattttatttttttctaccctgaggtctttcgacatgtggaaagtgaatttgaatgaaaaattttaagcattgtttgcttattgttccaagacattgtcaataaaagcatttaagttg

SEQ ID NO: 243 - DNA, 1123 bp, Mus musculus
atggtctgcgccaggcaccagcccggcgggctctgcctcctgctgctgctactctgccagttcatggaggaccgcagcgcccaggctgggaattgctggctccgccaagcaaagaacggccgctgccaggtcctgtataagacagaactgagcaaggaagagtgttgcagcaccggccggctgagcacctcatggaccgaggaggatgtgaacgacaatactctcttcaagtggatgattttcaacgggggcgcccccaactgcatcccttgtaaagaaacgtgtgagaacgtggactgcggacctgggaaaaaatgtcgaatgaacaagaagaataaaccccgctgcgtctgtgccccagactgttccaacatcacctggaagggcccagtgtgtgggctggatgggaaaacctaccgcaacgaatgtgcactcctcaaggccagatgcaaagagcagccggaactagaagtacagtaccagggcaaatgtaaaaagacttgtagggatgttttttgtccaggcagctccacttgtgtggtggatcagaccaataatgcctactgtgtgacctgtaatcggatttgcccagagccctcctcttctgaacagtacctttgtggaaatgatggagtgacttactccagcgcctgccacctgagaaaggccacctgcttgctgggcagatccattggattagcctatgagggaaagtgtatcacaaagtcctgtgaagatatccagtgtggcggcgggaaaaaatgcctatgggattccaaggttggcagaggtcgctgctctctctgcgatgagctgtgtcctgacagtaagtcggatgagccggtctgtgccagtgacaatgccacatacgccagcgagtgtgccatgaaggaagctgcctgctcttctggcgtgcttcttgaagtgaagcattctggatcttgcaactccatctcggaagaaacggaggaagaggaggaggaggaagaccaggactacagctttcctatctcttccattctagagtggtaaactctccaccaatgttcagtgttgacatagcctttgggcaaaacgaaacacaacaaaataaataataataataaataataaaaaaaaaaaa

SEQ ID NO: 244 - DNA, 617 bp, Mus musculus
agtttaaattttttgcccctttataacaaatttggatgtcagtttgtgtcatgtttatttttggattataagcagcgtaatctgtagatacctgatccctcgggttttgtttacaaggaatttggaattaacaaaagggattgtaactctgccacagtacaaggtacagagtatgggcatcttagaggaaatgtctgcttccgtcccctcgttctggtgaacgttgggagagaggatgagagagacattaagattttggagatgtgcttttatgatgttacagatccaaacacatagattgatgtgagtgtcaggagacttaagacaggtgaaaggcacactttcaacctgtcattcagcgtttcttttgagcttagtcagctgtaccttttcaattagttctttttcaaccaatgtgtcactaaaagttccatcaaagctttatcagttcaagtttcttgcttttcataagacttttttttgatgcaattttatattttcaaacatggcaagttaaatataaattcatttaaatatatagttttgtacttttctaccatgtaaatgtgcaatgtatataaaagttataatgtgtatttgtagataaatgatgagtg

SEQ ID NO: 245 - DNA, 3508 bp, Mus musculus
atatcgaattcgcggccgctgggaccagaggatggttgcagaggtctgaggaagggagggaggaagaagaggatgggagcaggtgacagtcacccggagagtcagaactgtgtcgtggaatgagaagcactttatggagcttggtgacatttccgtattccccccgaggagatgacgattaaggtggccattccagggtggcagaaaggaatgggaaggaggaggctcttccctaaagtccaaccgatcaatactcagtggatgtgaccagccagtgcccctgagaggctgggggagagccagactggggctttgtcctggaagcctcagcacaaggtccccagtagctagctgcccagcctcttcaccacacagggggctgcctcactcttcctgggcatcagggtggcctcgggtattctctctctcattctctctcattctctctctctttctctctctctctctctctctctctctctagcgggcgcgaattcgcgcccgctttgaagctttcagctgggacagagcttggttaagcaaccaacccgagtcatttgaatgcaatgattaccaggaagccaggcagcaggcacagttaccagccttccactggaagaagacgaggcttggtttcgagttccagagcgatgcctggccgaaaggtcacttgatagagattttcccgcgagacaggtagggtcattggcctctggaacctccctggggtggggcatttttgcgtcgtaattggttataagttacttggaggctgggcaatggatctgcttcggaagtctgtcaatgaaaaaaaggaaacagaaacaagctaagaaaagggaagggagagaagaacgagccaaggagctttgctcatcagagcctcatccgtgcgggatagtacatccgtgcgggatgatactgggacctggggaaaacgtaagttaaaggaagctttgctccaattctgtctctgaagacacttggctcatttcctgctttgggaagatgggctcttggaagtacagtcttttcagcctatctctcattgctgccttgatgcttatgtttatgtacgatagaaaattatggaagaactatcatttcccgagggcggtttccaatatttcagtcttagcggaagtctgcttgcagatgttcagtggggagagtttttatacagcggacagcgcacggaaaaccaccctggaaaacttcacctgccccgagtacaagattcaaaaccactacataacagagactctctctgaagaagaagcccgcttccctctggctttcacacttactatccacaaagattatgacactttcgagagactcttcagggccatttacatgccccagaacgtctactgtgtgcacgtggatagtaaggcgacagacaccttcaaagaagcggtgcggcagttactaagctgtttccccaatgccttcctggcctctaggatggagccggtggtctatggtggcttctcccggctccaggctgatctgaactgcatgaaagatctggtggcctccaagatcccctggaaatatgtcctcaacacctgcgggcaggactttcctctgaaaaccaacaaagaaatagttcagtacctgaaacggtttattgggaagaacctcaccccaggggtgctgcctcctgcacatgcagttggaagaaccaagtacgtccaccaggagctgttagaccataaaaatccctacgtgcacaatacagcaagattaaaagctcccccacctcacaacctgaccatttactttggcactgcttatgtggctctcacacgggaatttgctaactttgtcctcaaagaccagcgttcagtagacttaatctcctggtccaaggacacgtatagtcctgatgagcacttctgggtgacactcaataggatccctggagtccctggctccatgccaccaaacgcatcctggacgggtaacctcagagctgtgaagtggatggacatggaagcgaagcatggaggctgccatggtcactacgtccatggcatttgtatctatggaaacggagacttgcagtggctgattaattcgcaaagcctgtttgctaacaaatttgaactcaacacataccctcttaccgtggaatgcctggaactgaggcttcgagaaagaacactcaaccagagtgagatcgccatacagccgagctggtatttctgacccgcagcagctccggcctaaatggaaattgaagacgtaaagaagagctttcttttccaagagactctggtcttggctatgctgaagacttttttaaaaaatggttttcagggaaccgtgaggatctggcaacatggctctgcttgcaatatccactgagcactgtaatacatttgacaggatggctgcatgaaactgtccagcatttttctgtcgtttccccccacccccaaatccttttttctcttcttttttaaaagataggtagggtcttgctagatatctctagcaagcctgtttcttgtcaggtagcccaggatggccttgaactcttaatcctccgccttggccctctaagggctgctagtccgagtgtggacaaccacacctggctctggcgtctggcggtcacttgacgctcatctgcgtctccgtctgctaggtggtcggtgataaattcaaatgtatcagatctctgtgccagatactcatattagtataccctgttcaaaggagaatggtggataatactgtctgaggaaatcagaacttatttgagaaggaagctctcgttccacattcctagcaactatattctcaggcacacataggcgcacagagacagcttcctagtaactcacatcaatttcgtttaatacaaactgatcctgaagagctgaggaactatgtaagttcagtgtccaagcatttgactgacatttgtgcagagttaggttccatctccagcatcacgcacgggtcttgtgaacaccgacatcttcagtttacttgtgtctgcagttctgtggacagaacaaagccattcacaagtgaccgacagcacgtgccgtgagacgggaggtggctgcaggaagaggatgcctcagggatgccggacatttccgtgttctattccagagtgttctcttctcccagagaacactggaacgtcctcacagggatgaaggaattctttctttcccacaggaaaggtggtactgtgtgggtctggaacctgtgaatgaatcactcctggggtttcgtttctatgtgagagacggggacccggttctgttgtgtgcagctttagcggcatcaggacagcttccagcttgcaatgattgctgctgacaggaacacctggatctcaagagctttttatgacaggtggacatctgtgtcatttttccttgttccctcatccatccatccatccatccatccatccatccatccatccatccattcgtcagcctacattcaacaaaaagcctcttgaatgtctatgattccc

SEQ ID NO: 246 - DNA, 3537 bp, Mus musculus
atcggccccagaacagatctgactgcctctttcattcgcccggaggtagataggtgtgtcttaggaggctggagattctgggtggagccctagccctgccttttcttagctggctgacaccttcccttgtagactcttcttggaatgagaagtaccgattctgctgaagacctcgcgctctcaggctctgggagttggaaccctgtaccttcctttcctctgctgagccctgcctccttaggcaggccagagctcgacagaagctcggttgctttgctgtttgctttggagggaacacagctgacgatgaggctgactttgaactcaagagatctgcttaccccagtctcctggaattaaaggcctgtactacatttgcctggacctaagattttcatgatcactatgcttcaagatctccatgtcaacaagatctccatgtcaagatccaagtcagaaacaagtcttccatcctcaagatctggatcacaggagaaaataatgaatgtcaagggaaaagtaatcctgttgatgctgattgtctcaaccgtggttgtcgtgttttgggaatatgtcaacagcccagacggctctttcttgtggatatatcacacaaaaattccagaggttggtgagaacagatggcagaaggactggtggttcccaagctggtttaaaaatgggacccacagttatcaagaagacaacgtagaaggacggagagaaaagggtagaaatggagatcgcattgaagagcctcagctatgggactggttcaatccaaagaaccgcccggatgttttgacagtgaccccgtggaaggcgccgattgtgtgggaaggcacttatgacacagctctgctggaaaagtactacgccacacagaaactcactgtggggctgacagtgtttgctgtgggaaagtacattgagcattacttagaagactttctggagtctgctgacatgtacttcatggttggccatcgggtcatattttacgtcatgatagatgacacctcccggatgcctgtcgtgcacctgaaccctctacattccttacaagtctttgagatcaggtctgagaagaggtggcaggatatcagcatgatgcgcatgaagaccattggggagcacatcctggcccacatccagcacgaggtcgacttcctcttctgcatggacgtggatcaagtctttcaagacaacttcggggtggaaactctgggccagctggtagcacagctccaggcctggtggtacaaggccagtcccgagaagttcacctatgagaggcgggaactgtcggccgcgtacattccattcggagagggggatttttactaccacgcggccatttttggaggaacgcctactcacattctcaacctcaccagggagtgctttaaggggatcctccaggacaagaaacatgacatagaagcccagtggcatgatgagagccacctcaacaaatacttccttttcaacaaacccactaaaatcctatctccagagtattgctgggactatcagataggcctgccttcagatattaaaagtgtcaaggtagcttggcagacaaaagagtataatttggttagaaataatgtctgacttcaaattgtgatggaaacttgacactattactctggctaattcctcaaacaagtagcaacacttgatttcaacttttaaaagaaacaatcaaaaccaaaacccactaccatggcaaacagatgatttctcctgacaccttgagcctgtaatatgtgagaaagagtctatggcaagtaatcaggtataaattctcaatgatttcttatatattctgggtcttgggaaaacttgattctagaaatcaaaattaatttgacaaaggaaaagcagatgccggaaacttcttcccagtctgtcatacaattcaccactggccaggtgctgagagaagcattagggaacagtgtgggttgtgtcagagttggacggctccatccctttggcttcattatcttcctcctcatggagattctaaagcaacccagagaggctttgcagccagagacctttaataaggatgccaatgtgaccatcagtctgtaaaagctgatggctccaggagcgctggcagtccaggccccactaggctattgtttctgtcctgggcataaaggaggcagagagtgccaataggtactttggtggcacatgttcagagtccaggaaaaatcaagggtgaccacttagagggacataggacttggggttggtgattgaactgagttacaaacacagacagctttcttcaggatgactaacagcaggaattgaatggaaagtgtgttcattttgttttgcccaaattgtattcatgctgttagctttgtgtgttgagccctgtggagagggtgtgactgtatcagggaaggagagtacctcagcggactgaggaccagcaccctattatatcagaagacaatctctcatcatcaggtcctacctacaacctgctctgaacctccgagttcctcagcccatcgtgttccagtgtgggggcctgtatggagcaggtgactgaagacaaagccccctgtcacatgacctcatttcccctgctctagtactatgcaagtgtgacagccagccagccagatgtactggacaacataggaaccgactttatggcaatgggagccgcagtcactacaacggagctgctgaaggttctgttccccgctctgagagcctgcaggagcccctgtataggtggttctcaacctatgggtcgcgacccctttgggaagtgttaaatgaccctttcacaggtgtcccctaagacggttaaaaaacatagatatttccactctgactggtaacagtagcagaattacagttatgaaatagcaagggaaataattctggggttcgtgtcatccataccatgaggagctacattaggtcacatcattagggaagttgagaagcatagctctacttgggtatttaagcaaattatgcaaagggggttgtcgctctgtgttctgtgtatgcatatatttatattttgcttgtcttccagtttaggtcaatctgtttcttcctttaagcagtttatttaaaaggccattgcaccatcttggtgaacagcatgaggggtttcaataaaaaataggatcttacctttgtccacagggctctacctcttacttttcaattgtgaacaaaaaaggtcgcacacccagaggcaacaaaacccacagaattcctgaaccaatgggagatgccaatggaagcagagcttgcacatctgctaaaaattctgcctctctgtcactgtgctggatccgtctaaagtgggacagttcaatggtctgaaagtttcaaaaaggctggggaatttgaggggatttttttttaaaataaaattgatccaagtttaaatctctaatgagtaagcttaggattttattaaaggtaatttttagacattcttcaaaataagaattcttgtttataattgaataaattattttctca

SEQ ID NO: 247 - DNA, 2289 bp, Mus musculus
ctccgcgtggggagcgcgctgcgggatgccttccgccggcgggagccttacaactacctgcagagggcctactaccagttgaagaagctggacctggcagcttctgcagcacacaccttctttgtggcaaacccaacacacctgcagatgcgggaagacatggctaagtacagaaggatgtctgcaatccgaccccagagcttccgggacctggtgacgcccctatactgggcagcttatgacactggcctggagcttctggagcaacgggaggcagcactggctctaccccaactagaggaggccctgcaggggagcctggcccacatggagagctgccgtgctgcctgtgaggggcctgaggagcaccaaggggctgaagaagagggagaagggagccagggaggcctgtatgaagccattgcaggacactggatacgggttctgcagtgcaggcagcactgtgtggcagacacggccacccgtcctggtcgcagcttccctgtccaggacttcctcctcagccagctgagacggctgcacgaggcgtatgctcaggtggggaacatgtctcaggccatggaaaatgtcctgagtgtcctgctcttctacccagaggatgaggctgccaaaaaggctctgaaccagtaccaaactcagttgggagagccaagacctgacctgggaccacgagaggacatccagcggttcatccttcgctccctcggagagaagagacagttatattacgccatggagcatctgggcactagcttcaaggacccggattcttggaccccggaggctctcatccctaaggcactgagagagaggctcagagaggatcaagagaagaagccctgggaccatcagcctccacagcagaagcccttggctcactggaaggatgcccttctgatggagggtgtgaccctcacgcaggacgcccagcagctgaatgggtcggagcgagctgtcttagatgggctgctaacttcagccgagtgtggggttctgctgcagctggccaaggatgcagcacaggctggagccaggtcaggctaccgtggccgccgctctcctcatagtcctcatgaacgctttgaggggctcacggtgctcaaggctgctcagctggcccgggcagggactgtgggcaggccaggcgctaagctgcttctggaggtaagtgagcgagtgcggactttgacccaggcctacttctccccggaacggccactgcatctttccttcacccacctggtgtgccgaagtgccatagaaggtgaacaagagcagcgtatggacctgagtcacccggttcatgcagacaactgtgtcctggaccccgacactggcgaatgctggcgggagcccccagcctacacctatcgagactatagtggactcctctacctcaatgatgacttcaagggaggcgacctgttcttcacgcagcccaacgccctcactgtcacggctcaggtccgtcctcggtgtgggcgccttgtggccttcagctctggtggtgagaatccccatggtgtatgggctgtgactcggggacggcgctgtgccctagcactgtggcacacgtgggcacctgagcacagtgaacaggagtggacagaagccaaagagctgctgcaggaggaagaggaggaagaagaggaggaagacattctcagcagagacccttccccagaacccccaagtcacaagcttcagcgagtccaggagaaagctgggaagccccgccgggtccgggtccgagaggaactgtgaatggctgagcctgcttctcaggatcaggccactcaacttgggaaggaactgatgagaaggctctggaggatatcaggaacatagtagcatgccaagtctaccatctcggggacttacaagggctaccagaccctggactcacaagcttgctacacagacttagcctacagcacatcaggcccgggagccaggtctggccccagctgagggacctgcaaggtccccaggacagacaaaaatcactatgcctccctgaaaggcaggcatgtggaggagtgcagagcaactgcttctaataagaaacacacagaggggctggagagatggctcagcggttaagagcactgactgctcttctgaggtccagagttcaaatcccagcaaccacatggtggctcacaaccatccgtaatgagatctggcgccctcttctggggcgtctgaggacagcaacagtgtacttacatataataaataaataaatctttaaaaaaaaaaaaaaaa

SEQ ID NO: 248 - DNA, 926 bp, Mus musculus
ggaaccgcttctttctcgagtgcctggagacaaaaatcccacaagaataaggaagctctgaagcaggagtcatggcagccaaacctaagctctactactttaatggcaggggacggatggagtcgatccgctggctgctggctgcggctggagtggagtttgaggaagaatttcttgagacaagggaacagtatgagaagatgcaaaaggatggacacctgcttttcggccaagtacccttggttgaaatcgatgggatgatgctgacacagaccagggccatcctcagctacctcgctgccaagtacaacttgtatgggaaggacctgaaggagagagtcaggattgacatgtatgcagatggcacccaggacctgatgatgatgattgccgtggctccatttaaaacccccaaggaaaaagaggagagctatgatttgatactgtcaagagctaaaacccgttacttcccagtgtttgaaaagattttaaaagaccacggagaggcttttctcgttggcaaccagctcagttgggcagacatccagctcctagaagccattttgatggtggaagaactcagtgcccctgtactgtccgacttccctctgctgcaggcatttaagacaagaatcagcaacattcctacaattaagaagttcctgcaacccggaagtcagaggaagcctcctccagatggcccctatgttgaggtggtcaggattgtcctgaagttctagtgcagcgtgctttaaggtggcacccacaaggttccaattgcagtgtcaccacaggccagctgcagagcattccagaagcaaggtatatagatcccaggagtcaagctcttcaaacaacaaaaccactctgcccacaatgacaaatgccaattaaatacagtggaaaactaaaaaaaaaaaaaaaaa

SEQ ID NO: 249 - DNA, 1042 bp, Mus musculus
aagttcgccccaatcgcctgtctactcacgcgcttactgcccctcgccctgtggaccttactgccagtgagtgtacgctcgatcggccagaccccacggcgtcaccatgttgggcatgatcaggaactcactgttcgggagcgtggaaacgtggccttggcaggttctaagcaccgggggcaaggaagatgtctcctatgaggaaagagcctgtgaagggggcaagtttgctactgtggaagtgacagacaagccagtggatgaggctctccgggaagcgatgcccaagatcatgaagtatgtgggtggcaccaatgacaaaggagtcggcatgggtatgacagtccctgtctcttttgccgtgtttcccaatgaagatggctccctacagaagaaactgaaagtctggttccggattccgaaccaatttcaaggcagcccaccggcccccagtgatgagagtgtgaagatcgaggaacgggagggcatcactgtctattccacgcaatttggaggctatgccaaggaagcagactatgttgctcatgccacccagctacggaccacactggagggcacaccagcgacctaccagggtgatgtctattactgtgccggatatgaccctcccatgaagccctatggacgccgtaacgaggtctggcttgtgaaggcatgagtcacttgatgaactgagaacgtcctggaagggtgccactgtgtcccctgacttagggtcaaggggcgggagggtggggggaggtacttcttcagctccaatgttccttcaaaatccctcactgctgattttctgaaataagccaagattggcagcatcattcttgagttagaaagttctggggcagaccagaaaaaaaatcccagtggcatttcctctgccactaaaaactgatttttaataattatcgaatttgtatttttgttagtgaggaaatatgtgacttatgcatgaactttcttctgtgattcttttaagaactttgtctagaaagaaaccaaaaatacaaatctttgacgtaaa

SEQ ID NO: 250 - DNA, 1564 bp, Mus musculus
acggtctccagtcgcctccagagtttccgcatacaaccagtgagtggagcctgcccgcgcagagccgtctcgagcatagcccggagcctgaatcgagcagaaccagcctgaactagcccagtccggtgatggagcgtccacagcccgacagcatgccccaggatttgtctgaggccttgaaggaggccaccaaggaggtacacatccaagccgagaatgctgagttcatgaagaactttcagaagggtcaggtgtccagagaaggctttaagctggtgatggcttccttgtaccatatctacacggccctggaagaggagatagagcgcaacaagcagaacccagtctatgccccactctacttccctgaggagctgcaccgaagggctgccctggagcaggacatggccttctggtatgggcctcactggcaggaaatcatcccttgcacgccagccacacagcactatgtaaagcgtctccacgaggtggggcgcactcaccctgagctgctggtggcccacgcatatacccgctacctgggtgacctctcagggggtcaggtcctgaagaagattgcacagaaggccatggccttgcccagctctggggagggcctggctttttttaccttcccgaacatcgacagccccaccaagttcaaacagctctatcgtgctcgaatgaacactctggagatgacacctgaggtcaagcacagggtgacagaagaggctaagaccgccttcctgctcaacattgagctgtttgaggagctgcaggtgatgctgacagaggaacacaaagaccagagtccctcacagatggcgtcacttcgtcagaggcctgctagcctggtgcaagatactgcccctgcagagacaccccgagggaaaccccagatcagcactagctcatcccagacaccgctcctccagtgggtcctcactctcagcttcctgttggcaacagtggcagtgggaatttatgccatgtaaatgcaatactggcccccaggggctgtgaactctgtccaatgtggccttctctctgtaagggagaatcttgcctggctctcttctcttgggcctctaagaaagcttttggggtccctagcccactccctgtgtttcctttctctctggaatggagggagatacctgacacagttccctcaccaaaagcacatccagccagtggcctgaactttgaaaccagcagccccaaatcctgcagcagagccccaaaactggcctgtaaaagcagctgttctgagcccagtgcccatggttgtaagcatccatgttgactgaccacgactgctgtcccccagtgccatggccactttgatatccgtttccagacatttctgtctcgtatttctgtcttgttttttattatttccccagttctaccagagtaatggtattttgttgttttgttttgtcttgtttttcctaacaaagtggggctatcttttgaggggtgggtgggaaagaattatttaatagttgtaaccttggtctctaacttctgtgtgaaataataaatggcattatctaac

SEQ ID NO: 251 - DNA, 2456 bp, Mus musculus
ggctgcgaaagttgggggagtgtgctagaaggactgcggagcggagcgcacgcgggaccaggctcgactgggtcgctggtcccggccacagggagtgggagccggctggagatgccctgtattcaagctcaatatggaacaccagcaacgagcccaggaccgcgtgaccacctgaccggtgatcccctggcccttgagttcggcaagcctaccatggacctggccagccccgagacagcacctgccgcacctgctacactgcccagcttcagcaccttcatggacgggtacaccggagagtttgacaccttcctctaccagctgccggggacgacccagccgtgctcctcagcttgttcctctgcctcctccacgtcttcttcctcatcctcggccacctcccccgcttcggcgtccttcaagtttgaggacttccaggtgtacggctgctacccgggcaccctgagcggcccattagatgagaccctatcctccagcggctctgagtactatggcagtccctgctcagccccctcgccatctacacccaacttccagccgtcccagctttctccctgggacggctcatttggccacttctccccgagccagacttatgaaggcctctgggcatggacagagcagttgcctaaggcttcttcagggcctccgccacctccaaccttcttctccttcagtcctcccactggccccagccccagcctggcccagagttctctgaaattgttcccaccaccagccacccaccagcttggggagggggagagctattccatgccagcagctttccccggcttggcacccacctctccgaaccgtgacacttccggcattctggacgcacccgtgacctccaccaagtcccggagcggggcttcaggtggcagcgagggccgctgtgcagtctgtggtgacaatgcttcgtgtcagcactatggggtccgcacctgtgagggctgcaagggcttcttcaagcgcacagtacagaaaagcgccaagtacatctgcctggcaaacaaggattgccctgtggacaagaggcggcggaaccgctgccagttctgccgcttccagaagtgcctggctgtgggcatggtgaaggaagttgtacggacagacagcctaaaagggcggcggggccggctaccttcaaaacccaagcagcctccagatgcctcccctaccaatcttctcacttccctcatccgggcacacttggactccgggcctagcactgccaaattggactattccaagttccaggaactggtgctgccccgcttcgggaaggaagatgccggtgacgtgcaacaattttatgacttgctctctggttccctggacgttatccgaaagtgggcagaaaaaatccctggcttcattgagctttgcccaggagaccaagacctgttgctagagtctgccttcctggaactcttcatcctccgcctggcataccgatctaaacccggtgaggggaagctcatcttctgctcaggcctggtactacaccagctgcagtgtgcccgtggctttggtgattggattgacaacatcctggccttctcacggtccctgcacagcttgggtgttgatgttcccgcctttgcctgcctgtccgctctggtcctcatcactgatcgacacgggctccaggaccctcgtcgggtggaagagctgcagaatcgcattgctagctgtctgaaggagcacatggctaccgtggcaggagacccacagccggccagctgcctgtcacgtctgctgggcaaactgcctgagcttcggaccctgtgcactcaaggcctgcagcgcatcttttgcctcaagttggaggacttggtaccccctccacctattgtggacaagatctttatggacacattgtctttctgacccctgccctgaacatgtgtgcgcacacgtggtgctcttctgtcacccatgtgcctttaagcctatagcccacggacccccagaccaccctacccccagcctggttttgagctaagactgacgtacctcctcactccagaagatggacagagaactcaagacctgggggagggtgtgtattcacgggggtgaccccactatttgtcttatccctccagctcagtcctggccttcgtgtgtttttgtaagataaaccatttttaacacataccactctgttgtaaataagctgacgctactgtaaatacagaaaggaagaggttgagatgggggttgggaggaaggggtggggctcccaccagctgggcgagcctccaactcgagatctcttccgctctccttccatgtgtacataactgtcactcaagaaggtgattgacagattctgatttatatttgtgtattttcctggatttataggatgtgacttttctgattaatatatttaatatattgaataaaaaatagacatgtagttg

SEQ ID NO: 252 - DNA, 2987 bp, Mus musculus
ggtcagagccgacctccagcacttcctgtgtaagggatgagcatacaccaggatagggtgataaggggacaggaaggaggtttcctctggagccaaggggaataggactgctggctttcgattctttggtggttccgtctcctgaacctgcaaaatcaccagtatgggagtcaagctgtgcaagtggacaggaccatttacatttctggacaggtaggcctggatccttccagtggacagcttgtgccaggaggagtagtagaagaagctaaacaggctcttaaaaacttgggtgagattctgaaagctgcaggctgtgacttcaataatgtggtgaaaacaactgttttactggctgacatgaatgactttggcactgtcaatgagatctataaaacatgtaagtgatttgaccttattctcactcacttttaaagggaaataagtctgctgatataaatgtatcattgtcaagtaaaagtgagatgtgaaaatggcattttgtcctgacacaatccattatctggttggaaacacagtagtagcatgcccttgtgagaaagatctctatttctattgcagttcttaaaaatataatgtgcataagctctgcatattcattttcctagaacctaactttattgtttgtttctctggctttgtaagcctcccctaaatctttttagacatacagacttattgctatgatatggtctagctaccttcttgtggctctctgcaaatcaccgggaacttactgaacatttccatactagttcttagtccgtaaagtgaggacaggattctgccaccttcgggcgttgtcagaatgattacattaattatcctgtacagcacttagaacagatactggcaaggtctaagctccgagcaaatgctcctgttgctgtcattgccgtagcaggggaagtgagtccctgtctcctggtaagatgaaatgaaggtatagtgtgaaaaaaacttcactgttattctctgcagaagatgtgaccacagaaggttaaagttcacagggaagtcctcgctgaagatcaggagccaccctcagttttgataattggttcataggaatcactttaaagaccaaacccacactcatcattataagacaagggtgccagattatgtgtttcattgcttataaagtacttagaaaagtaccaaaggtcataaaatcgtgtggcagaatatcttgtcaggcaatctaaatgcaagcttttctgtcgtttgtgtgtgggaacagaccaggccatgaggccgttcccagattcttgcttctcttgctgagtgagggcccatgtgtggagattaacctgatactgttttacattcagatttccagggtagccttcctgccagggctgcttaccaagtcgctgctttacccagagtaagtacctggtacaatgccagtgcacacacagtacatgagacctgtcgctttgaaaggaaacttaaaattaatacagttcctgtttctcagaaatacagagtctaaaagtcaatacctgatcactgttgtgatctgaaaaaagcttaaaaaaattcgtacaaagcagcacatgggtatgacatgatccatcggacacaatctgatgacttagattataagaaaaaccttaagagcagttgtgttgtgatgttactggagcagtgtagattgctgggccccactgtgtttccccctgcagtctgacttcatgcctcagtgtctgcctttcagtaaggacttctgaaaatgtaacacagtgtacaattacgtggagacttctggatagcctttgttctcactgaagggagttcttcataccacaaggtgtaaaactaatgctcttgctagttcctactgtattttggagtattggccagaaaatgtggatagtattactatttatcttaataaaaacaaattcacctggctctcctattatgaagactctagaccattcactggaaagatgctctccatcctggttctggtgttccgtcactgtggtctcttttcctatgcctcctgcccactctgtacacctgcagggcgtaactgaaccacctcagagtgtcgtttgttcttgctttagtttgttgttcctgggaaaggtcattgtcaaactgaaagtattgagtgtattagaaaaagcttatacttggaacctgaagacatgggtttgattatccactgctagtctttgtgatgtgggaccactttgtcagcctttctgaggtcagtgccttgttttacgaccagggctgctgtgggaatcaaatgagctaatatataagtgtgcctagcatggtagcctgacttgttgtagaggcttagtgaattctctctcatccttgctttctgtgaagagattaatggtaaaaatacatgttgccagtagttgcatgtgttattgaaccttgacttgcattaaaggatcgagacagtgacttttgttttctttacagggaagtcgagttgaaatcgaagcaatcgctgtccaggggcctttcatcaaggcatgactataagtagccatgctgatgttgactccggaggttttagaatgtctttcacactttaatttttacaaatgatgctgggaagtataaaaatgaccagagtggttgaagttattgtggaagtgatcaaatatgtggagatttgacattaattggagattattcagtatagtgactgatgttctaatttcacttatgttgctgggtgtgagagaagaggtgcacagctactgagatgggaagcagaaggaaagatgggctgttgtacatgagaaatagtaaggagcacatctacttaaatcatattaatttgctcatgtgaaatacttagttcttatgttagatataagaaactaaattgaaatattcaaacttgaatagtaccaggagaacaagtggaccaaaatcttatacagataatattactttaattgaaataaaaaatagatgtgtaactt

SEQ ID NO: 253 - DNA, 601 bp, Mus musculus
atgaccgagcgccgcgtgcccttctcgctgctgcggacgccgagctgggaaccattccgggactggtaccctgcacacagccgcctcttcgatcaagctttcggggtgccccggttgcccgatgagtggtcgcagtggttcagcgccgctgggtggcccggatacgtgcgcccgctgcccgccgcaccagccttcagccgagcgctcaaccgacagctcagcagcggggtctcggagatccgacagacggctgatcgctggcgcgtgtccctggacgtcaaccacttcgctccggaggagctcacagtgaagaccaaggaaggcgtggtggagatcactggcaagcacgaagaaaggcaggacgaacatggctacatctctcggtgcttcacccggaaatacacgctccctccaggtgtggaccccaccctagtgtcctcttccctatcccctgagggcacacttaccgtggaggctccgttgcccaaagcagtcacgcagtcagcggagatcaccattccggttactttcgaggcccgcgcccaaattgggggcccagaagctgggaagtctgaacagtctggagccaagtagaagccat

SEQ ID NO: 254 - DNA, 634 bp, Mus musculus
atgaccgagcgccgcgtgcccttctcgctgctgcggacgccgagctggggaccattccgggactggtaccctgcacacagccgcctcttcgatcaagctttcggggtgccccggttgcccgatgagtggtcgcagtggttcagcgccgctgggtggcccggatacgtgcgcccgctgcccgccgcgaccgccgagggcctcgcggtgaccctagccgcaccagccttcagccgagcgctcaaccgacagctcagcagcggggtctcggagatccgacagacggctgatcgctggcgcgtgtccctggacgtcaaccacttcgctccggaggagctcacagtgaagaccaaggaaggcgtggtggagatcactggcaagcacgaagaaaggcaggacgaacatggctacatctctcggtgcttcacccggaaatacacgctccctccaggtgtggaccccaccctagtgtcctcttccctatcccctgagggcacacttaccgtggaggctccgttgcccaaagcagtcacgcagtcagcggagatcaccattccggttactttcgaggcccgcgcccaaattgggggcccagaagctgggaagtctgaacagtctggagccaagtagaagccat

SEQ ID NO: 255 - DNA, 2079 bp, Mus musculus
ggcgaacgcggagcgcgacgcagcgcggcccgggctcggcccagcccccgatgcgctccggagccggggtccggagctgagcacggcggctcgggggtccgggcccccagtccgtaggtgcgccgcgggccaccatgtccttcccccagctcggataccagtacatccgccctctctacccacccgaacgcccgggagctgcgggcggcggtggaggcggcagtagcgctgggggccggagcggtcccggcgccggagcctccgagttggccgcctctgggtccctatccaatgtgctttcatcagtgtacggggcaccctacgccgctgccgcagctgccgccgccgccgctcagggttacggcgccttcctgccctacgccacggagctgcccatcttcccacagctgggcgctcagtatgagctgaaggacagccctggcgtccagcatccggccacggccgccgcgttcccgcacccgcaccccgccttctacccctatggccagtaccagttcggggacccgtcccgtcccaagaacgccacccgggaaagcacgagcacgctcaaggcctggctcaacgagcaccgcaagaacccgtaccccaccaagggcgagaagatcatgttggccatcatcaccaagatgaccctcacccaggtgtccacctggttcgccaacgcgcgccggcgcctcaagaaggagaacaagatgacgtgggctccccgtagtcgcacggacgaggagggcaatgcttatgggagcgagcgggaggaggaggacgaagaggaagacgaggaagagagcaaacgcgagctggagatggaggaggaggagctcgcaggagaggaggaggacacggggggcgaggggctggccgacgacgacgaggatgaggagatcgatttggaaaacttagacagcgcggcagccgggtcggagctgaccctggctggggcggcgcacaggaacggcgacttcggcctgggacccatttcggactgcaaaactagcgactcggacgacagctccgaaggcttggaggaccgaccactgtcggtcctgagcctggccccaccgccaccgcccgtggccagggctcctgcatctccaccttctccaccctccagcctggatccctgcgctccggccccggcgccctcctccgccctccagaagcccaagatctggtcactggccgagacggccaccagcccggacaacccacgccgctcgcctcccggagccggaggttcgcctcccggcgcagccgttgcgcccccgacgctgcagctctcgcccgcggccgctgcagcggctgcagcggcacacagactcgtgtcggcgccgcttggcaaattccccgcttggaccaacaggcctttcccagggccgccggccggtccgcggccgcacccgctgtccatgctgggctcggccccacagcacctgctgggacttcccggagccgcaggtcatcccgctgcggccgcagccgcctatgctcggcctgccgagccggagagtggaacagatcgctgtagtgccttggaagtggagaaaaagttactcaagacagctttccagccggtgccaaggcggccacagaaccatctggacgctgctctggtcttatcagctctctcctcgtcttaacttttcaaccatttttaaatcgttgtactaattgtaaaaaacaaaacaaaacaaaatcgctctgtatagtgacgagttgcaagcatgtctgtgtatgattaccttaaaagaaacactaaacaacaacaacaacaacaacaacaacaggaaaggacaaaagaaagaaagaaagccagtccccccaccttggccctcccccaagtcaccccacatttagattgtgaggttccttcgttgtgttgatttcggggggggggggagtggggttacggagagaacaagcctgtctgactctttttgtatatacgggaaaatgtacatacgtgtgaaccaaattgtacaagaaagtatctattttttggctaaataaatgagctgttgccacttttgactataaaaaaaaaaaaaaaaaaaaaaaaaa

SEQ ID NO: 256 - DNA, 1538 bp, Mus musculus
tataaggcctgggtgggccgggccacagcacacacagtccctgccatggcgctcagcgagcctatcttgccgtcctttgccactttcgccagcccgtgcgagcgcggcctccaggagcgctggccgcgaaatgaacccgaggcgggcggcacggatgaggacctaaacaacgtgttggacttcatcctctccatgggattggacggtctgggcgccgagaatcctcccgagcccccgccgcagcccccgccgcctgccttctactacccggagccgggtgctccgccgccctacagcatccccgcggacagcctgggaacagagctgctgcgccccgacctggacccgcctcaggggccggctctgcacggccgcttcctccttgcgcctcccgggcggctagtgaaggccgagccccccgaggtggacggcggcggctacggctgcgctccgggcctggcccacggaccgcgcggtctgaagctcgagggcgccccaggagcgacaggtgcatgcatgcggggtcccgccggccgccccccgccgcccccggacacgccgccgctcagccccgacggccccctgcgcatcccggcgtccggtccacgcaacccgttcccgccgcccttcggtcccggccccagcttcggcggtcccggccccgcgttgcactacgggcctcccgcgcctggcgccttcggtcttttcgaggacgcggcggcagcggcggcggcgctgggcttggctccacctgccacgcgcggtctcctcacgccgccctcgtccccgctggagctgctggaggccaagcccaaacgcggccgccgctcctggccccgcaagcgcgccgccacacatacttgcagctacaccaactgcggcaagacctacaccaagagctcgcacctaaaggcgcatctgcgtacacacacaggtgagaagccttatcattgcaactgggaaggatgcggctggaagttcgcgcgctctgacgagcttacccgccactaccgaaagcacacaggtcacagaccctttcagtgccacttgtgcgaccgggccttctccaggtccgaccacctggccttgcacatgaagcgacacatgtagcctgggtcgactcggctagcccatgcgcgactgtggcaggttccacgcgcggggcacggtccccttgcaaacagactgctatttattggaccttaggacagagccggacaagtgtggccacaggaaaatgactctgccaccagttctggccccacagtgactgaaggccccaggaaagaagacaggagtctgtgaagatgttttcaaaatggtgcaataattgacttatttccctcgggtccccactagaggatcgaggctagatgccttgtgagaaatgcctttgagtttactgtccccaacgtttttataatattgtatataagactatgaccgattgtatttctataagggagacgatggcatctctgccgcctgcttcgtttttatacgacttttttttaattaaagttttggatctttggagg

SEQ ID NO: 257 - DNA, 658 bp, Mus musculus
gtttgtttttttgtttgtttgtttttagtatttctgttttgtctcttgaactcttcctttctcctgattatccattcacaagctgacttgctgggaacttgaccatgattgtagcgcttgccagctgggctcctcccctcgtgggaagacagtgtgaaaggttagaaaaaaaaatactgaactctctctcctggcagtgtgggtcacatccactacgtgggatttaaaagtgcctcttcatgtgtaaggcaaggtggtccgacctggaaaaggccctgtcacacttctggcactgaaagggccggtgccctgtgtgtttgcggtagtgcctggtcagttcatcggagcgggcgaatttccacccacagccgtcccagtcacagtggtaaggtttctcgcctgtgtgagttcgcaggtgtgccttgagatgagaactcttggtataggttttgccacagcctgcatagtcacaagtgtgggtggctgttcttttccggggccacgaccttcttcccctctttggcttgggctcctctggcaggcaggaacccggtggcatgagctcttgataatggagagaggggacttgtgactgcatctggtctggcaggaaaggagggtagttgggccccggatggggatggaatcctgggggaag

SEQ ID NO: 258 - DNA, 868 bp, Mus musculus
  modified_base (586)..(586): a, c, g, t, unknown or other
ttgttttttttaaatctcaaaagttaatgtgattcaagagagtggttctgctaaacaaactgaagcacaccggtcgttacattaaatgagaagaaaaaacaattctgagagtcagcaagcatcaaggatccagagtcactgtgggaggccaggggtcaactcacccagtcagacgtatgtacaccaccagtctgaatcttcagaatcctacccctcgtcttggccttgccccctcccccctcccccaaaaacaaaggagaaaataccaaaagcatttatttgcctgccctccaacagtcagagacggttcagagttgcctctgcaaggggaccaaatgttgactttgaccttagggctaccatgtgctttttgggaaacagtgcagggagatatcagaatattggccaaagaagcagtgacctcctgtggccagcgcgcctctgctgtggcagatttccatgtgtcagtctgtttcctgggagctctgtccttccggggacccatctctgcctggctgccatggggagcacctcacaaggggctggcaagagccttttttgatctcttgatcatgctgggatgganactcgtgtgacgccgggcatgcttggtgagatggtcactcctcatgaatctcttctcacacagtgggcaacagaactgctttttcccagtgtgggtcccgtgtgggcggtcagctcatcccagcgccgagactttttaaaagagtctgtggcagtgcacaggaaaaaggccgtcacctgtatgcaactctgtaatggcctttaataaggggaagatttccataactttccaccacccactgtaggggggctggtgctttttttttgggggggcggtcccctt

SEQ ID NO: 259 - DNA, 264 bp, Mus musculus
agttctattttatcttttcatttttttccctccaacgggggagggggaaagcctaagacgaggggtaggattgagaagattcagactggtggtgtaaataaatccgactgggtgagttgacccctggcctcccacagtgattttggatccttgatgcttgctgaatttcagaattgttttttcttttcatttaatgtaacgaccggtgtgcttcagtttgtttagcagaaccaatttcttgaatcacattaacttttgagattt

SEQ ID NO: 260 - DNA, 268 bp, Mus musculus
aagacggcaaccttaaattgagcccacttttttccaacttatatacacttatttactttttctcaatgttcatacctactttcaactagttaccgcctagactgggggacgaaggttcccagagatggggtgaacctgctggggctggtgagaattctagaggtgcggcgattggtggctacagcaaacactaaggaacccttcaccccatttcccttctgcacttctgttctcccctccaaatcaatacactagttgtttccttccc

SEQ ID NO: 261 - DNA, 4050 bp, Mus musculus
gagtcctgaaagtaatctccaggaccaggactctgcttccagcctctggagttgtgcctagtcgaagtgcccccctccttgggccccacccgccatgagagctgtcagtgtgtggtattgctgcccatggggactactgctgctacactgtctgtgcagcttcagtgtggggtctccgtctccttctatcagcccagagaagaaggtaggaagccaggggctgaggttccggctggctggctttcctagaaagccctatgaaggtcgagtggagatacagcgagctggtgaatggggcaccatctgtgatgatgacttcacgctgcaggctgcccatgtcctctgccgggagctgggcttcacagaagccacagggtggacccatagtgccaaatatggccctggaacaggccgaatctggttggacaatctgagctgcagggggactgaaggaagtgtgacagaatgcgcctctcggggctggggaaacagtgactgtacccatgatgaggatgccggggtcatctgcaaggaccagcgccttcccggtttctcagactccaacgtcattgaggtggagcatcagttgcaagtggaggaggtgcgactccgacctgcggtggagtggggaaggagacccctgcctgtgactgagggcctggttgaagtcaggcttcctgaaggctggtcgcaagtgtgtgacaaaggctggagtgcccacaacagccacgtagtctgcggtatgctgggcttccccggagaaaagagagtcaacatggccttctacaggatgctggcccagaagaagcaacactcctttggtctgcacagtgtggcatgtgtgggcacagaagcccacctctccctttgctctctagagttctatcgtgccaatgacaccaccaggtgctctgggggaaaccctgcagtggtgagctgtgtgctgggccctctttatgccacctttactggtcagaagaagcagcaacactctaagcctcaaggggaggctcgtgtgcgtctaaagggtggtgcccaccagggagaaggcagagtggaagtcctgaaggctggcacatggggaacagtctgtgaccgaaagtgggacctgcaggcagccagtgtggtgtgtcgagaactgggctttggcactgcccgagaggccctgagtggtgcccgcatggggcagggcatgggtgccatccacttgagtgaagttcggtgctctggccaggagccctccctttggagatgcccgtccaagaacatcacagctgaggactgttcccacagccaggatgcgggtgtccggtgcaacctcccctacactggggtggagaccaagatccgactcagtgggggccgcagccggtatgaagggcgagtcgaggtgcaaatagggatacctgggcatctacgctggggcctcatctgtggggatgactggggaaccctggaggccatggtggcctgtaggcaacttggtcttggctacgccaaccacggcctgcaggagacctggtactgggactcagggaatgtaactgaggtggtgatgagcggagtgcgttgcacggggtctgagctgtccctgaaccagtgtgcccatcacagcagccacatcacctgcaagaagacgggaacccgcttcactgcgggggtcatctgttctgaaactgcttcagatctgctgctgcactcggcactggtacaggaaactgcttatattgaagaccggcccttgcacatgttgtactgtgctgctgaagagaactgcctggctagctctgcccgctcggccaactggccttatggccaccggcgtctgctccgattctcttcccagatccacaacctaggaagagctgactttaggcccaaggctgggcgccattcctgggtgtggcatgagtgtcatgggcattaccacagtatggacatcttcactcattatgatatcctgacccccaatggcaccaaggtggctgagggccacaaagctagtttctgtctagaagacactgagtgtcaagaggatgtctccaagaggtatgagtgcgccaactttggagagcagggcatcaccgtgggatgttgggatctctacaggcatgacattgactgtcagtggatcgacatcacagatgtgaagccaggaaactacattcttcaggtcgttatcaacccaaattttgaggtagcagaaagtgacttcaccaacaatgcaatgaagtgtaactgcaaatacgacgggcatcgcatctgggtgcacaactgccacatcggtgatgccttcagcgaagaagccaacaggaggtttgagcgctaccctggccagactagtaaccagatcgtctaaaatgctaccaccctctctgtaaaccaccactggcccccaatggcaggggtctgaggctgccattacctcaggagcttaccacaagaacccctgatgtcagcaggcgccctacactcaaccacctgtgcactacaggcaacaaactgtcaaacagaagttggtgcctcctttacggggtcagctgtcattacctttggccaacaagcatggagaatcagccaacagccccagcaacagacagaacacaccacaaagaactgccccacacaggatggcagcagctcattctcttgaataggggaggtcaagagggtcagctcccatcgctctccgttctcctaaggaccgcgttacctctagccatttggtgggggagaagatccaacccccacttttgactgtaacatgttgctaggtataattttattttatataaaatgtgttcttcggagcccaggactgatgcagcggttagagggacttgccctccgcaggttcactgactcctcctctacccacatgcactcagaacctaggctaggaaagcaaggaggagatcagggcaagagcttcacactcttgccggtccagtcattcattctgtgacctcgggggtcacatataaggtcagtgtctctgatccgcgccggatccgcactgccagctgtgattgggttcgaacagcttcataaacatcttcagcattttgtgccaatttctccccaatggccaagatcacatcaccaggccgcagaccagccctgtggaggatggacggggcaaggagagaatagacagagaagttcaaggatacatccacccatcccatcccacccaacccccccccccagagcacgctccccatcacctgtgtgcgggggagcccaggataactttatgaatgaggacaccatgctgaacatcagggaagcttggctcacggagctgtagttcaataaggatgctgaaagggcacagacactattagctccacacaggccctctcccatcttaatagttcaccttctgccttctagagcttaggaagtgggatatacacataaaagatagctaatttcgaaagatacatggtgttgatcaacttcacttctgtcatcctgaagggttagaacttaagctgagcctagaagggtgggtcctaccaccttacgaaataaggtattgagacatagaagtggaaaatgaaagtagttccgaagaaacggcaagctgtctggaaggataacgagatgggtgggaatgggcgggaatgggcctccagtgctaggtcaatgttggctttacatcacagcaatagcaggatgtactcaatctactgaaagatccagatgcagtgggatgagaaagttatgagagggaacagtgcttgtgacagaagacaacagcttatcttaggaaaaaacagacatgagagaaaacccaagaaaaggatagggtgtgtgtatggtgtgtgtgtaggggtgtgtgtgtgtatgtatgtataggtgtatatatatatacatatatatagatatatgtatatatcaccacactaacatacatatatatgtatatgtatatatcaccacactaacatacctgggagtcagggtcagcatcatcactccaatgtagcggcgctgggacccactggttccaaaccaggaatctgtaataaaagaggacaaacg

SEQ ID NO: 262 - DNA, 6807 bp, Mus musculus
catggcgtggataaaagaggcgaaaaagcagggggcggtttccaaaaataaaacccttcggttccccttcagacggcggcagtgcgggagcgaaggtgcggcaggctcgggctcggtgcgcagcccgggcagctcacgccatacagcccttgcctaggaacccctggaccccgaaacggctgtttcagaggtcccctagacgggaggggggcaagccgccagcggggtctgtggagcgaacgatggagagcacctccccgcgaggtctccggtgcccacagctctgcagccactctggcgccatgagagcgccgaccaccgctcgctgctccggatgcatccaacgggtgcgttggaggggcttcctgccacttgtcctggctgtcttgatggggacaagtcatgcccaacgggattccatagggagatacgaaccagctagcagggatgcgaatcggttgtggcaccccgtgggcagccaccccgcagcggctgcagccaaggtgtacagtctgttccgagagcctgacgcgccggtccccggcttgtcgccctctgagtggaaccagccggcccaggggaacccgggatggctcgcagaggccgaggccaggaggccacctcgaacccagcagctgcgtcgagtccagccacctgtccagactcggagaagccatccccggggccagcagcagatagcagcccgggctgcaccttctgtcgcgcgcctggaaacccctcagcgacccgcggctgcacggcgagggcggctcactgggagaaatgtctgcgggggacagtgctgcccaggatggacaacatcaaacagcaccaaccactgtatcaaacctgtgtgtcagcctccctgtcagaaccgaggctcctgcagcaggccccaggtctgcatctgccgttctggcttccgtggggcgcgctgtgaggaggtcatccctgaggaggaatttgaccctcagaatgccaggcctgtgcccagacgctcagtggagagagcacccggtcctcacagaagcagtgaggccagaggaagtctagtgaccagaatacagccgctggtaccaccaccatcaccacctccatctcggcgcctcagccagccctggcccctgcagcagcactcagggccgtccaggacagttcgtcggtatccggccactggtgccaatggccagctgatgtccaacgctttgccttcaggactcgagctgagagacagcagcccacaggcagcacatgtgaaccatctctcacccccctgggggctgaacctcaccgagaaaatcaagaaaatcaaagtcgtcttcacccccaccatctgcaagcagacctgtgcccggggacgctgtgccaacagctgtgagaagggtgacaccaccaccttgtacagtcagggtggccatgggcatgaccccaagtctggcttccgtatctatttctgccaaatcccctgcctgaatggtggccgctgcatcggccgggacgagtgctggtgtccagccaactccacaggaaagttctgccatctgcctgtcccgcagccagacagggaacctgcagggcgaggttcccggcacagaaccctgctggaaggtcccctgaagcaatccaccttcacgctgcctctctctaaccagctcgcctctgtgaacccctcgctggtgaaggtgcaaattcatcacccgcctgaggcctctgtgcagattcaccaggtggcccgggtccggggtgagctggaccccgtgctggaggacaacagtgtggagaccagagcctctcatcgcccccacggcaacctaggccacagcccctgggccagcaacagcatacccgctcgggccggagaggcccctcggccaccaccagtgctgtctaggcattatggacttctgggccagtgttacctgagcacggtgaatggacagtgtgctaaccccctaggtagtctgacttctcaggaggactgctgtggcagtgtggggaccttctggggggtgacctcctgtgctccctgcccacccagacaagagggtccagccttcccagtgattgaaaatggccagctggagtgtccccaaggatacaagagactgaacctcagccactgccaagatatcaatgagtgcctgaccctgggcctctgcaaggactcggagtgcgtgaacaccaggggcagctacctgtgcacctgcaggcctggcctcatgctggatccgtcaaggagccgctgcgtatcggacaaggctgtctccatgcagcagggactatgctaccggtcactggggtctggtacctgcaccctgcctttggttcatcggatcaccaagcagatatgctgctgcagccgtgtgggcaaagcctggggtagcacatgtgaacagtgtcccctgcctggcacagaagccttcagggagatctgccctgctggccatggctacacctactcgagctcagacatccgcctgtctatgaggaaagccgaagaagaggaactggctagccccttaagggagcagacagagcagagcactgcacccccacctgggcaagcagagaggcaaccactccgggcagccaccgccacctggattgaggctgagaccctccctgacaaaggtgactctcgggctgttcagatcacaaccagtgctccccacctacctgcccgggtaccaggggatgccactggaagaccagcaccatccttgcctggacagggcattccagagagtccagcagaagagcaagtgattccctccagtgatgtcttggtgacacacagccccccagactttgatccatgttttgctggagcctccaacatctgtggccctgggacctgtgtgagcctcccaaatggatacagatgtgtctgcagccctggctaccagctacaccccagccaagactactgtactgatgacaacgagtgtatgaggaacccctgtgaaggaagagggcgctgtgtcaacagtgtgggctcctactcctgcctctgctatcctggctacacactagtcaccctcggagacacacaggagtgccaagatatcgatgagtgtgagcagcccggggtgtgcagtggtgggcgatgcagcaacacggagggctcgtaccactgcgagtgtgatcggggctacatcatggtcaggaaaggacactgtcaagatatcaacgaatgccgtcaccctggtacctgccctgatgggagatgcgtcaactcccctggctcctacacttgtctggcctgtgaggagggctatgtaggccagagtgggagctgtgtagatgtcaatgagtgtctgacccctgggatatgtacccatggaaggtgcatcaacatggaaggctcctttagatgctcctgtgagccgggctatgaggtcaccccagacaagaagggctgccgagatgtggacgagtgtgccagccgagcctcgtgccccacgggcctctgcctcaacacggagggctccttcacctgctcagcctgtcagagcgggtactgggtgaacgaagatggcactgcctgtgaagacttggatgaatgtgccttccctggagtctgccccacaggcgtctgcaccaatactgtaggctccttctcctgcaaggactgtgaccagggctaccggcccaaccccctgggcaacagatgcgaagatgtggatgagtgtgaaggtccccaaagcagctgccggggaggcgaatgcaagaacacagaaggttcctaccaatgcctctgtcaccagggcttccagctggtcaatggcaccatgtgtgaggacgtgaatgagtgtgttggggaagagcattgtgctcctcacggcgagtgcctcaacagcctgggctccttcttctgcctctgtgcacccggctttgctagtgctgaggggggcaccagatgccaggatgttgatgaatgtgcagccacagacccgtgtccgggaggacactgtgtcaacacagagggctccttcagctgtctgtgtgagactgcttccttccagccctccccagacagcggagaatgtttggatattgatgagtgtgaggaccgtgaagacccggtgtgcggagcctggaggtgtgagaacagtcctggttcctaccgctgcatcctggactgccagcctggattctatgtggcgccaaatggagactgcattgacatagatgaatgtgccaatgacactgtgtgtgggaaccatggcttctgtgacaacacggacggctccttccgctgcctgtgtgaccagggcttcgagacctcaccatcaggctgggagtgtgttgatgtgaacgagtgtgagctcatgatggcagtgtgtggggatgcgctctgtgagaacgtggaaggctccttcctgtgcctttgcgccagtgaccttgaggagtacgacgcagaagaaggacactgccgtcctcgggtggctggagctcagagaatcccagaggtccggacagaggaccaggctccaagccttatccgcatggaatgctactctgaacacaatggtggtcctccctgctctcaaatcctgggccagaactccacacaggccgagtgctgctgcactcagggtgccagatggggaaaggcctgtgcgccctgcccatctgaggactcagttgaattcagtcagctctgccccagtggtcaaggttacatcccagtggaaggagcctggacatttggacaaaccatgtatacagatgccgatgaatgtgtactgtttgggcctgctctctgccagaatggccgatgctcaaacatagtgcctggctacatttgcctgtgcaaccctggctaccactatgatgcctccagcaggaagtgccaggatcacaacgaatgccaggacttggcctgtgagaacggtgagtgtgtgaaccaagaaggctccttccattgcctctgcaatccccccctcaccctagacctcagtgggcagcgctgtgtgaacacgaccagcagcacggaggacttccctgaccatgacatccacatggacatctgctggaaaaaagtcaccaatgatgtgtgcagccagcccttgcgtgggcaccataccacctatacagaatgctgctgccaagatggggaggcctggagccagcaatgcgctctgtgcccgcccaggagctctgaggtctacgctcagctgtgcaacgtggctcggattgaggcagagcgcggagcagggatccacttccggccaggctatgagtatggccctggcctggacgatctgcctgaaaacctctacggcccagatggggctcccttctataactacctaggccccgaggacactgcccctgagcctcccttctccaacccagccagccagccgggagacaacacacctgtccttgagcctcctctgcagccctctgaacttcagcctcactatctagccagccactcagaaccccctgcctccttcgaaggccttcaggctgaggaatgtggcatcctgaatggctgtgagaatggccgctgcgtgcgtgtgcgggagggctacacttgcgactgctttgagggcttccagctggatgcgcccacattggcctgtgtggatgtgaacgagtgtgaagacttgaacgggcctgcacgactctgtgcacacggtcactgtgagaacacagagggttcctatcgctgccactgttcgccaggttacgtggcagagccaggccccccacactgtgcggccaaggagtagaagtgagggcttgtgtgggcagctatctggaaaatggcttcagccataggccgtggacttaagattgcttccctagctgggaagacatcgcgctgggaagatgacgtgatgacatcaggacccgaggactctggacccagttctgccagccttgccaaatttttatttcttccagcttaactctgggtgtgagacttccatcactgacctctatgccattgcttggctcagacaccacaaatatcttaatgcttcaccgactggccatgagacacgcccaccagtctgccccgggaccacactatagggcactcatcaggctgtgctcttaggctgtgcaaacattgcaggtacccccttttccagttgcgagccacacatcatcctagttgttctgtaatggggacagtggctgcatccggcccagggatggtctcttcacagtctgtggaggcaagagagggtttggggagtagctcctgtcacctctcagaaccaacaccaccactcggccaggctggcatgaggctctttttgccacatctccatctcttagacagttctgcagcccctcatctcagaggatgaagactaatactaactcgctgagtggtaagaaatacaaaggacgaggaacagtgagcctgagaaagtacggcaagagagtgatgtggaaaacatgggcgagctgatacgaaaggaggagccaagagttaaagaaatctaaaaacactgagttgctttgggcaaataagtacttgaagccccttagaggctctgtgtgcctgcagtgaggcttgtcataagctctggcgcccatatgcaaaggcctttcttaggcacatctatcctatgggaaacccaaatagatgggctaacaatataaaggtctccttttcagctggtcttggcagaggaggccaggttttcaaagttgtttatctcctccactcagaagcacttgcccttgttccctctaagaaatgcacttccatacaagctagctgggggttcaggagcatgggggaataaaatgttcatctggaaaaaaaaaaaaaaaaaa

SEQ ID NO: 263 - DNA, 519 bp, Mus musculus
aaagggtgtgaacggtttatttgaggcactagaatagcagcaggaagccagtgtgggcagagagggcaggatgggactcaactgcatcgggtagtgggagccttcatctggaggggtggcagtcctccatgggcagcctcctgaacagagtacaaggtgggtacaatgataccagggggaggggttttggtggcgacacaggccttctgctgtagaatcttttcaggtcttctttgcccaccccagaatccaagtggcttcattcacacagggatacactgagcacacagatatacatctatttggattagacatccttgtcagtgtgtccacaagattcggcgctgactctggtactcttgagactccaaggagatcttcaccccttcgctggttccccaagggaggttataggattggctctggaagcaagggtagccagtaccacttcaacagagcaggtatgggtgagtttggtacttagccctgacgttgagagagtgtggagggggaactaga

SEQ ID NO: 264 - DNA, 285 bp, Mus musculus
ttttccctcttccccgcatccactaatgcattcacaaggtccacattgggtaattgcaccagcgcaccacatggccaagaaattaacccactaagcctcatggcgcgcctaaaagcttaggattcttctcctttctttctttctttctttctttctttctttctttctttctttttttttttaaaggtaaattattacgatgtattttgtgaggcaggtttacaacactacacgttttgaataagaaggaaagagaaaaaaataaaaacaccaatacccagattt

SEQ ID NO: 265 - DNA, 745 bp, Mus musculus
gttacatatctattactccttctcctgctctcttaccatttgcacagtatggccattactggtagccacagattcatgccaaggctattgtgtgtctgtggaaagaaagctggaccaaaatagctgctgctatgtcctccacctgcacctgtccatgtgagccatgcggtgtgccataacagagtctggaactccaggctcaggcttgggcctctctactaggaggtggtccagatgtaccagacccaccatcctgctgcaggcccagctggtctagcaggagaggacacagaggttttgtctctagacggcccctaggcctgcctctgtatttctcacctgcaggtgcttgagcttgcctttctaggcagatggagttgtgcaccaaactgtggctggacagttcctacctttctgtgtgccccaagccttccctgcctctggtgggtcagttagcctctcaccccttgtgcctgcacagagggtcttgatcccaggctagcaagcaagttctcaggcctctaaactagggcactagggcaggttccgtgccagagtcaggggctacacaaggggcctggtgccagtgcggtgggcgagttatgagacctgagctgcagactggaatgggaccccatcccagcctgttcaaacaggatgggcgctgtgcctgtggtcatttctgtcattggtaatatagacttacaggattttttataccttcaagaaaacaaccacaaaacag

SEQ ID NO: 266 - DNA, 321 bp, Mus musculus
ccctctattcctcaacacaacctattcaccccttaagctgtataccattctcatgagcttagggagaagaaatcctgtattctcagcctaccatgagtatacataatttgcccaatctagtgttccccgctgtactgtggacatcatttccttctactcccacactgaaatttcattttcggcagaaaactgactccacaaattgctattttttgtactggaatttaccttgatgtgtatatggacatgtgcataattcacagagacatatgttctgtaataagttggatttctacacaatattaaaattcaccattccat

SEQ ID NO: 267 - DNA, 1710 bp, Mus musculus
gaggagccgccgccttctcgtcgctcgagctctggacgaccatggtcgctcaggccccgtccgcggggcctccgcgctccccgtgaagggtcggaagatgcgcgggaagtagcagccgtctgctgggcgagcgggagaccgaccggacacccctgggggaccctctcggatcaccgcgcttctcctgcggcctccaggccaatgtgcaataccaacatgtctgtgtctaccgagggtgctgcaagcacctcacagattccagcttcggaacaagagactctggttagaccaaaaccattgcttttgaagttgttaaagtccgttggagcgcaaaacgacacttacactatgaaagagattatattttatattggccagtatattatgactaagaggttatatgacgagaagcagcagcacattgtgtattgttcaaatgatctcctaggagatgtgtttggagtcccgagtttctctgtgaaggagcacaggaaaatatatgcaatgatctacagaaatttagtggctgtaagtcagcaagactctggcacatcgctgagtgagagcagacgtcagcctgaaggtgggagtgatctgaaggatcctttgcaagcgccaccagaagagaaaccttcatcttctgatttaatttctagactgtctacctcatctagaaggagatccattagtgagacagaagagaacacagatgagctacctggggagcggcaccggaagcgccgcaggtccctgtcctttgatccgagcctgggtctgtgtgagctgagggagatgtgcagcggcggcacgagcagcagtagcagcagcagcagcgagtccacagagacgccctcgcatcaggatcttgacgatggcgtaagtgagcattctggtgattgcctggatcaggattcagtttctgatcagtttagcgtggaatttgaagttgagtctctggactcggaagattacagcctgagtgacgaagggcacgagctctcagatgaggatgatgaggtctatcgggtcacagtctatcagacaggagaaagcgatacagactcttttgaaggagatcctgagatttccttagctgactattggaagtgtacctcatgcaatgaaatgaatcctccccttccatcacactgcaaaagatgctggacccttcgtgagaactggcttccagacgataaggggaaagataaagtggaaatctctgaaaaagccaaactggaaaactcagctcaggcagaagaaggcttggatgtgcctgatggcaaaaagctgacagagaatgatgctaaagagccatgtgctgaggaggacagcgaggagaaggccgaacagacgcccctgtcccaggagagtgacgactattcccaaccatcgacttccagcagcattgtttatagcagccaagaaagcgtgaaagagttgaaggaggaaacgcagcacaaagacgagagtgtggaatctagcttctccctgaatgccatcgaaccatgtgtgatctgccaggggcggcctaaaaatggctgcattgttcacggcaagactggacacctcatgtcatgtttcacgtgtgcaaagaagctaaaaaaaagaaacaagccctgcccagtgtgcagacagccaatccaaatgattgtgctaagttacttcaactagctgacctgctcacaaaaatagaattttatatttctaact

SEQ ID NO: 268 - DNA, 3028 bp, Mus musculus
ggctttgttaacggggcctccggggccagcgtagcctaggagcggccggtgaggagccgccgccttctcgtcgctcgagctctggagcgaccatggtcgctcaggccccggccgcggggcctccgcgctccccgtgaagggtcggaagatgcgcgggaagtagcagccgtctgctgggcgagcgggagaccgaccggacacccctgggggaccctctcggatcaccgcgcttctcctgcgggcctccaggccaatgtgcaataccaacatgtctgtgtctaccgagggtgctgcaagcacctcacagattccagcttcggaacaagagactctggttagaccaaaaccattgcttttgaagttgttaaagtccgttggagcgcaaaacgacacttacactatgaaagagattatattttatattggccagtatattatgactaagaggttatatgacgagaagcagcagcacattgtgtattgttcaaatgatctcctaggagatgtgtttggagtcccgagtttctctgtgaaggagcacaggaaaatatatgcaatgatctacagaaatttagtggctgtaagtcagcaagactctggcacatcgctgagtgagagcagacgtcagcctgaaggtgggagtgatctgaaggatcctttgcaagcgccaccagaagagaaaccttcatcttctgatttaatttctagactgtctacctcatctagaaggagatccattagtgagacagaagagaacacagatgagctacctggggagcggcaccggaagcgccgcaggtccctgtcctttgatccgagcctgggtctgtgtgagctgagggagatgtgcagcggcggcagcagcagcagtagcagcagcagcagcgagtccacagagacgccctcgcatcaggatcttgacgatggcgtaagtgagcattctggtgattgcctggatcaggattcagtttctgatcagtttagcgtggaatttgaagttgagtctctggactcggaagattacagcctgagtgacgaagggcacgagctctcagatgaggatgatgaggtctatcgggtcacagtctatcagacaggagaaagcgatacagactcttttgaaggagatcctgagatttccttagctgactattggaagtgtacctcatgcaatgaaatgaatcctccccttccatcacactgcaaaagatgctggacccttcgtgagaactggcttccagacgataaggggaaagataaagtggaaatctctgaaaaagccaaactggaaaactcagctcaggcagaagaaggcttggatgtgcctgatggcaaaaagctgacagagaatgatgctaaagagccatgtgctgaggaggacagcgaggagaaggccgaacagacgcccctgtcccaggagagtgacgactattcccaaccatcgacttccagcagcattgtttatagcagccaagaaagcgtgaaagagttgaaggaggaaacgcaggacaaagacgagagtgtggaatctagcttctccctgaatgccatcgaaccatgtgtgatctgccaggggcggcctaaaaatggctgcattgttcacggcaagactggacacctcatgtcatgtttcacgtgtgcaaagaagctaaaaaaaagaaacaagccctgcccagtgtgcagacagccaatccaaatgattgtgctaacttacttcaactagctgacctgctcacaaaaatagaattttatatttctaactatatgacccccaaattagacaacatgggtattatttttatacattaaagccagaaaactgtcttagtccacataaaattcacttataatttatcctggagagtaaatatggtgaatattttcttcctttttagggaaatttcacttgtttattttatatttgtgttttaagtaatttgcattggctgtttatattttccttatattttaaataatctccgcttggaaggactttggaagtgtatgtgagaagtcctttccatctcctgcagatgatggtggaccttcctcatcaagggctacagaagtacttgatttctgttttttttgttaataataagaacatttaatttatttagtgtctttcatgtaaagagttaaagactatgtgaaggattgtatatttaagttattgaaattctgaaactgtagtaatctaaaatgtgtgagttgtgggctgcagagaagactcagccagtaaaggcacctgctgtgtacacccactgacacacatttgatccttggaacccccaggaagagtgaaccagttccacaaagttgttccctgatcttcaaatggatgcacgcatgcacgcacacacacgcgcgcgtgcgcacacacacacacacacacacacacacacacacacacacacacacacacacagttttaaaggcatgaattgcatctggtggtatgtaagtgaaaacacacgccttattttccagcattttcagctttttgtcataggggtgtggcacaagtgttgcagtttgtcccaggttgaaaagcctgaggctggtagaagcgcctttttgcctcagctccgtggttcctggtggttgcctatgtttcaggcctgtacttaggctaggtttagaaaccagcccattcagaaagactgaatcagaacatggataaagtgaactcattctaagatgactcgtctatccatgtagattaatctcctggttcataataggcctcttccctttgattgaagggtcacgtctaagtatagaaaacataaaactgtaaggtagaggaagcgaaggatagctttgtattaatgttgcgttaaagcttcagagacaagaacaagaacactcctcccacgtgacagcatttgaataggaggcggtgggtgcggcagcctgggcagcttcagtcccgatttacaataaagtaccttgtgtgttattagttcttaaatgtttatttagaaatggcattgatgttatttatttgcaaataaatggtttattg

SEQ ID NO: 269 - DNA, 329 bp, Mus musculus
cattgcaccctttcaaaaccaacccataattttaattcctctaaattttatatctccagcaaacgaacacctgacctactagagaccaattcactatgttcggcgtctggaagaagagcgtcctgaaccatcactaccaatgcaggaaatcaggaagggtatgcttgtaaatcttactacacaatgtgtatatgttatgtgatggctcccttgtcctaacctgattgatgacattccacattgtaaaaaccaaactattcaatttctactgtttattcccatcttgtatatttaagccattaaatgtttggatatttctctttacagct

SEQ ID NO: 270 - DNA, 9193 bp, Mus musculus; identical to SEQ ID NO: 29

SEQ ID NO: 271 - DNA, 672 bp, Mus musculus
atgctcattccagcccaagagccccctttctcaaatgaccatggtttccagatacatgtaatagtgaaaacccaatctcacaatgcagattaaagttccaaaactaagcttcagaggaaggtgcacagaccactcacaaatattactctacatattacttggagttgaacataaaatgatcagcgttttagaaatattcatcttttatacataaaagtaccaatatcatttctattataagttttacattagactctccatgttcttcccagaatattcattttaagtttggtggttttgttccaacccagattgacccctgtctcctctgttaagggtgatgaaacttttcattaaagcatctgtgaactgtaaggccacaactattgctctaataatgtcaactagctcattcatttttataagttaattacagtaactttatcccactgtattattttgtgtccatgactcattttctctgtgactgaacgctcaccaagagcactgaacacagttctatttttatgatacttaatagcatatttgagttaaatatacaataaacattgtgaaatctatccaagtagaagggttctgtttatatggaaaaaacaagttagtataatcttgaataaatcaacagaaataaagcgacaagattgagaatgg

SEQ ID NO: 272 - DNA, 672 bp, Mus musculus; identical to SEQ ID NO: 271

SEQ ID NO: 273 - DNA, 4026 bp, Mus musculus
ctgtggacattttaccatgcagccataaagagaggtcaaaaatgtctttcaagtgcccggttagtaaagatctgatggcgttctaaggagagaaaggaacttggatcttcgtggacaaagaattcaggtctgtagctgaaggaggcgtggccacacagggcgtttccaggtcctgtagaggaagcacagttcatagatctctgttctaacacgtctgtcttgctctgaacgccgaaagtcaactcgatcacaagtttgatccaacagtttgacatttcaggtaattttcagacggagcgctggggttggatctcccaagcaacacaattggctctgtgcaggacacctggcacggggcactgggtcgcagctcgtcccctctccctccaggaacaacgatgctcaaggaccagcttttcctcccaggcctctcccacttcccttctcaccggtgctgcccgcccggtcccgggaaccgcgcccgtcgcagggtcccgatcgttccccctacatcccttgggaccaggagcaaattcctgtgggtcccaggagtgccaaaagtgctcagcgagacgggaaattgcaacagtacttggcccttcggccctcccccggcgctttcccgtaactcccgcccctggacacttgtcccgtagttgattcatagctggggcgcggggccgcctccacacgcctggacagacgtccgcgcccgttcccctgtgaggccgaggaccggcaaggctccggagcaggtcgccaggcgggtaatcagaccaatggctttctctgtggtccttcatccagccttcctcctggcagtgctgtccctgagggcatcccgaagcgaagtcttggaggagcctttaccattgactcctgagatacataaagtttcttttcaattgaaacttcaagaagtgaatttagaatggactgtcccagcccttactcatgaagaattaaacatgatatttcagatagagatcagtagactgaacatatccaacaccatctgggtggagaattatagcaccactgtgaagcgtgaagaagctgtgcgttggaactggacgtctgatatccctttggagtgtgtcaaacatttcataagaatcagggctctggtagatgacaccaagtcccttccacagagttcctggggcaactggagttcctggaaagaagttaatgcaaaggtttccgttgaacctgataaatcattaatatttcctaaagacaaagtgttggaagaaggctccaatgtcaccatctgtctgatgtatgggcagaatgtatataatgtatcctgtaagttgcaagatgagccaatccatggagaacaacttgattcccacgtgtcattattaaaattgaacaatgtagttttccttagtgacacagggacaaacatcaattgtcaagccacgaagggtcctaaaagaatatttggtactgttctctttgtctcgaaagtgctcgaggaacctaagaatgtttcctgtgaaacccgagactttaagactttggactgttcatgggaacctggggtagatacgactttgacttggcgtaaacaaagattccaaaactacactttatgtgaatcgttctctaagagatgtgaggtttctaactacaggaactcctatacctggcaaatcactgaaggctcacaggaaatgtataactttactctcacagctgaaaaccaactaaggaaaagaagtgtcaacattaattttaacctgacccatagagttcatccaaaggctccgcaggacgtcacccttaaaattataggtgctacaaaagccaacatgacttggaaggttcactcccatggaaacaactacacacttttgtgtcaggttaaactccaatatggagaagtgattcatgagcacaatgtttctgtccacatgagcgcaaactacctcttcagtgatctggatccagacacaaagtacaaggcttttgtgcgctgtgcaagtgccaaccacttctggaaatggagcgactggacccaaaaagagttcagcacacccgagactgctccctcacaggctcttgatgtatggagacaagtgtggtcggagaatggaagacgcattgtgactttattctggaagccactattaaaatcacaggccaatggcaaaatcatatcctataatatagttgtagaaaatgaagccaaaccaactgagtcagaacactactgtgtctgggcaccagccctcagcacaaacctgagccttgacctgcaaccttacaagattcgcatcacagccaacaacagcatgggggcatctcctgagtccttgatggtcctttctaatgattctggacacgaggtcaaggaaaagacaattaaaggtataaaggatgcattcaatatttcttgggagcccgtatctggagacacgatgggctatgttgtggactggtgtgcacattcccaggaccaacgctgtgatttgcagtggaagaaccttggtcccaataccacaagcaccaccatcacctcagatgattttaaaccaggcgtccgttacaacttcagaatttttgaaaggtctgtggaacacaaagctcggttagtagagaaacaaagaggatacacccaggaactggctcctttggtgaatccaaaagtggagattccttactcgacccctaactccttcgttctaagatggccagattatgacagcgacttccaggctggttttataaaagggtacctcgtgtatgtgaaatccaaggagatgcagtgcaaccaaccctgggaaaggaccctccttccagataattcagtcctctgtaaatacgacatcaatggctcagagacaaagacactcaccgtggaaaaccttcagccagagtccctctatgagtttttcgtcactccgtacaccagcgctggcccaggacccaatgaaacgttcacaaaggtcacaactccagatgcacgctcccacatgctgctgcagatcatactacccatgaccctctgcgtcttgctcagcatcattgtctgctactggaaaagtcagtgggtgaaggagaagtgctaccctgacattcccaatccgtacaagagcagcattctgtcactcataaaatccaagaagaatcctcacttaataatgaatgtcaaagactgcattccagatgtccttgaagtgataaacaaagcagaaggcagcaagacacagtgtgtaggctctgggaaacttcacattgaagatgtacccactaagccgccaatcgtgccaacagaaaaggattcctcagggcctgtgccctgcatcttctttgagaattttacttacgatcagtcagcttttgactctggttcccatggcctcattccaggtcccctaaaagacacagcacaccaacttggactattggctccacctaacaagttccagaacgtattaaaaaatgactacatgaagcccctggtcgaaagtccaactgaagaaactagcttgatttatgtgtcacagctggcttcacccatgtgcggagacaaggacacgcttgccacagaaccacccgtgccagtgcatggttcagagtataaaaggcaaatggtagttcccgggagcctcgcatcaccttctctgaaggaggataacagcttgacctcaacggtcctcttaggccaaggtgaacagtaaacaccacgcagcacaaataaatgcactccacacactataggcactttgggagatgtagctgttaccatgccaacaccacgtgccctggttggttccaggggtgggggttgaggggagactcattatctgcagtgctgatttatcaacgatcactacagaccaacagacttaaggaccatataatatggtgttcaccctgaaggcgttccctagaaatggcagatccgagagcatgctgaccttgctattatttggtccaggctcacccttattgcagtagcttgacatagggtgtacaccagtcatttcgcagagcctacctactcaaaactac

SEQ ID NO: 274 - DNA, 746 bp, Mus musculus
cagtatttttctctttattacttctaaaatataaattttggacattcaaaagtgcaacagttaacgtgcctgtggggaatatcacagttaaaaaaaatataaacaaaggcagtgatacagcttgtcatacacattttggcagtattctccaagtctacatagcaacagatatatacatatcgatgtataacatcgttttatcttacgtccctcttcacaaatataggaccattttgtacaggttggcagaccacatttttttaaggacatcattgatcatttttttaaaagtcacaaattgtgttcctcgggcaagctttgattgtcatcataaaaatagaaagcaggaaagattggtaaattttcttccagggactctgcaggaggccagaaagaaaacaaatcaggatacagtcaaaacactgtttaaaaataaaaatgtatccctgctgagtgtggtggtgcatgcctgtaatcccagcactgggggtacagagacagtggatctctgagagttcaaggctagcctggtttacacagtgagttccagggcagccagggctgcgtagaaagaccctgtctcaaaaaacaaaagtgaacgtattcccattgaatctcagaggtgggtacagctaaagatgggaaactgctggtctgggaagtatcatccaacttcatggtgtcatgcaaggcccaaagcgacatcagaataaaaagaagcaacaaacagaggctgtgcaaatgag

SEQ ID NO: 275 - DNA, 1905 bp, Mus musculus
atggaagaactttccatggcaaacaccatgtttgccctcaatctccttaagcagatagaaaaatcaaactctacccagaacatctttatctctccatggagcatctcatcaacattggccatagttctcctcggtgctgggggtaacactgaacagcagatggccaaagtgctgcagtttaatgaaattggcagttatggtatcaccacaagaaacccagagaacttcagtggctgtgatttcgcacaacagatacagaaggaaaattatcctagtgctattttacaggcacaagcaggagataaaatccattcagccttctcctctctcagctcaacaatcaacacaccacagggggattatttgttagaaagtgcaaacaagctgtttggagagaagtctgcaagattcaaagaagaatacatccaactctctaagaaatattactcaacagaaccagaagcagtggacttccttgaatgtgctgaagaagctagggaaaagattaattcttgggtcaagactcaaaccaaaggtgaaatcccaaacctgctacccgaaggttctgtagatgaagacaccaagatggtgctggtgaatgctgtctacttcaaaggaaagtggaaaactccatttgagaagaaacttaatgggctttatcctttccgtgtgaactcgcatgagagcatacctgtccagatgatgttcctccatgcaaagctgaacattggatacataaaggacctgaagactcagatcctagaacttccgcatactggaaacatcagcatgctcctgttgcttcccgatgagattgaggacgcatccactggcttggaattgctggaaagtgaaataaactttgccaacttcaacaagtggatcagcaaagacacactggatgaagatgatgttgtggtctacattcccaagttcaaactggcacaaagctacgaactcaagtccattcttcaaagcatgggcatggaggatgccttcaacaagggcaaggccaacttctcaggaatgtctgagaggaatgacctttttctttctgaggtgttccatcaagccagcgtggatgtcaccgaggagggcactgtggcagctggtgggactggggcagttatgacaggaagaactggccatggtggcccacagtttgtggccgatcatccctttcttttctttatcatggacaaaattacccacacgatactatttgttggtagattctcctcaccctaaaaggggaagacctatttccacatgaggttttgtagcatgaactataagcctcagaattgcatcttcaagtgccaaaagtttaaatactttcttacacatttttatacttctgctatacactaaatataacctaaaagcaattgtatagcagtcttcagtgcttacagtataactctattaatgattttgtttcctaaagtcagatgatgtctatttagttcatccttattactgctttgtctttataactttagtttttacagtgttatttattgtttatataatggttgttttacaaattgttgtcctctgtttaatgaaactgtaacactacagaagcagaaaattagataattttctatttaaagaaaatcagccatttaatttaataatgaaggaaaaatatgagtcttccatactttcccatgatattcacccagaaaaaatgtacttaacaaaagacatgttatatctctatcattatatatcatatgtacgtatctgcaactcatctataattaggactacatcataagtaagcatgcttacttacacactgctatctgttgtataaaacttagcaatccttatttgttagttatctttctatcactgtaacaaaatacctgagataataaagttcaaagatttattttg

SEQ ID NO: 276 - DNA, 2299 bp, Mus musculus
tgccagcgcccttccgctgcagtcaccgaactgctgtctagagcccagcggcactaccatgaaagtctggctggcgagcctgttcctctgcgccttggtggtgaaaaactctgaaggtggcagtgtacttggagctcctgatgaatcaaactgtggctgtcagaacggaggtgtatgcgtgtcctacaagtacttctccagaattcgccgatgcagctgcccaaggaaattccagggggagcactgtgagatagatgcatcaaaaacctgctatcatggaaatggtgactcttaccgaggaaaggccaacactgataccaaaggtcggccctgcctggcctggaatgcgcctgctgtccttcagaaaccctacaatgcccacagacctgatgctattagcctaggcctggggaaacacaattactgcaggaaccctgacaaccagaagcgaccctggtgctatgtgcagattggcctaaggcagtttgtccaagaatgcatggtgcatgactgctctcttagcaaaaagccttcttcgtctgtagaccaacaaggcttccagtgtggccagaaggctctaaggccccgctttaagattgttgggggagaattcactgaggtggagaaccagccctggttcgcagccatctaccagaagaacaagggaggaagtcctccctcctttaaatgtggtgggagtctcatcagtccttgctgggtggccagtgccgcacactgcttcattcaactcccaaagaaggaaaactacgttgtctacctgggtcagtcgaaggagagctcctataatcctggagagatgaagtttgaggtggagcagctcatcttgcacgaatactacagggaagacagcctggcctaccataatgatattgccttgctgaagatacgtaccagcacgggccaatgtgcacagccatccaggtccatacagaccatctgcctgcccccaaggtttactgatgctccgtttggttcagactgtgagatcactggctttggaaaagagtctgaaagtgactatctctatccaaagaacctgaaaatgtccgtcgtaaagcttgtttctcatgaacagtgtatgcagccccactactatggctctgaaattaattataaaatgctgtgtgctgcggacccagagtggaaaacagattcctgcaagggcgattctggaggaccgcttatctgtaacatcgaaggccgcccaactctgagtgggattgtgagctggggccgaggatgtgcagagaaaaacaagcccggtgtctacacgagggtctcacacttcctggactggattcaatcccacattggagaagagaaaggtctggccttctgatggccctcaggtagctgagggaagaaacagatgggtcacttgttcccatgctgaccgtcctctctgcaacagagtcgtcaaatggagggaagaagctgaaaagacaggttttgcattgatcctctgctgtgctgcccaccagggtgagcgccaatagcattaccctcagacacaggcctgggtgctggccatccagaccctcccgaccaggatggaaagttggtcctgactcaggatgctatagaccaggagttgcctttttatggactaaagccatctgcagtttagaaaacatctcctgggcaagtgtaggaggagagctgtttcccttaatgggtcattcatgagatctgctgttgggaaataaatgatttcccaattaggaagtgcaacagctgaggtattgtgagggtgcttgtccaatatgagaacggtagcttgaggagtagagacactaacggcttgagggaacagctctagcatcccatgaatggatcaggaaatgttatatttgtgtgtatgtttgttcactctgcacaggctgtgagtataagcctgagcaaaagctggtgtatttctgtatctaactgcaagtctaggtatttccctaactccagactgtgatgcggggccatttggtcttccatgtgatgctccacgtgaatgtatcattcccgggcgtgacccgtgactagcactaaatgtcggtttcactttttatatagatgtccacttcttggccagttatctttttttttttttttttttttttttttttttttttttttactaattagcctagttcatccaatcctcactgggtggggtaaggaccacttctacatacttaatatttaataattatgttctgctatttttatttatatctatttttataattctgagtaaaggtgatcaataaatgtgatttttctgaag

SEQ ID NO: 277 - DNA, 1806 bp, Mus musculus
gaaccgcggcgaggaggggggtcggaggcccagacttataaaggctgctggacccgcgctacccgccagaccccgccgcccggatcccccgcgctgcctgtcgccccacgtgaccacactactaagcttggtcgccatggtcctgctctgggccctcttcctagcgctcctggcaggtgcccacgccgagctcccgggctgcaagatccgcgtcacctccgcggctctggatctggtgaagcaggaaggcctgcgctttctggaacaagagctggagaccatcaccatcccagacgtgtacggcgcaaagggccacttttactacaatatctcggacgtgagggtcacacagctgcacctgatatcctcggaactccacttccagccagaccaagatctgctgctgaacatctccaacgcatccttggggctgcacttccggaggcagctactctactggttcttatatgatgggggctacatcaatgcctcggcggagggtgtgtccatccgaacaggtctacagctctcccaggattccagtggtcggattaaagtgtccaatgtctcctgcgaggcctctgtgtctaaaatgaatatggccttcgggggaaccttcaggaggatgtataactttttctccacgttcatcacttctgggatgcggttcctcctcaaccagcagatctgccctgtgctctaccatgctgggacggtgttgctcaactccctcctggacacagtgcccgtgcgcagttctgtggatgatctcgtgggcatcgattactcccttctgaaggatcctgtggtctccaacggcaacctggatatggaattccggggagcattcttccctctgaaggaggacaactggagcctccccaacagggcggtggagcctcagctggaggacgacgagaggatggtgtacgtggccttttccgagttcttctttgactctgccatggagagctacttccaggctggagcgctgcagctgacacttgttggggacaaggtgccgagtgacctggacatgcttctgagggccacctactttgggagcattgttctcctgagtccgacagtgattaactccccactgaagctgaagctagaggccacgagccctccacgttgtaccatcaagccgtcaggcaccaccatctccatcaccgccagcgtcaccatcaccttggccccgcccatgttgcccgaagtggagctgtccaagatgatcatggaaggccgtctcagtgctaagttgacactccggggcaaggcgctgcgagtgaagctggaccttcgaaggtttcaaatctactcaaatcagtctgcgctggagtctctggcgctgatcccactgcaggccccactgaagacactgctgcaaatcggagtgatgcctttgctgaacgagcgtacctggcgtggggtgcagatcccccttcctgagggtatcaacttcgtgcgtgaggtggtgaccaaccacgcgggcttcgtcactgttggggctgacctccactttgccaaagggcttcgagaagtgattgacaagaaccgtcctgcagacgttgcggcctcccatgtccccccaccctctgctgcagctgcctgagcccatcaccccacctgggtggctggcattcaggaacctaactgaagtcttctctgcaccccctgccaaccccttcccatctacagtgttagtggtcccggtgccacagagaagagcccagttggaagctatacccgatttaattccagaattagtcaaccatcaattagaatccatccacccccctc

SEQ ID NO: 278 - DNA, 578 bp, Mus musculus
  modified_base (574)..(574): a, c, g, t, unknown or other
gaggggggtggatggattctaattgatgggggactaattctggaattaaatcgggtatagcttccaactgggctcttttctgtggcaccgggaccactaacactgtaaatgggaaggggttggcagggggtgcaaagaagacttcagttaggttcctgaatgccagccacccaggtggggtgatgggctcaagcagctgcaacataaggtggggggacatgggaggccgcaacgtctgcaggacggttcttgtcaatcacttctcgaagccctttggcaaagtggaggtcagccccaacagtgacgaagcccgcgtggttggtcaccacctcacgcacgaagttgatacccttaggaagggggatctgcaccccacgccaggtacgctcgttcagcaaaggcatcactccgatttgcagcagtgtcttcagtggggcctgcagtgggatcagcgccagagactccagcgcagactgatttgagtagatttgaaacctttcgaggtccagcttcactcgcagcgccttgccccggagtgtcactttacactgagacgggcttccatgatcatctnggac

SEQ ID NO: 279 - DNA, 3222 bp, Mus musculus
ggtcccggcccggccggcctggcgcatggaggcggccgcacgcctgcgggcgcggattgtgccttctgaagaccagggtgggattgatggagaagccccaggagggcagctctgactactgccgttcccaacaccgtgggtgctgccgctgaggagacctgtacacctctggccctcaccattgtccttgcctcccaatggcctctgctgccaggccggaggcagcactgctgcctgagcccgctgcccctcttcaggacttgccgttccctgatggggtaacgtgacagaccggatcagaggctgcctgcccaccacggcccagggccgctagagtttggttgagttcaagttcattttccctttggtcctgacttctggggcccaactctgaccaaaggggacactcctccgtccacccatgcagagagggtgtctccagcgacggccccatagaggacactgctctgcggccggagtcaccaacccgaagttctctctgctcagttttttttggttgttgttatttttattttgactccttgtaacttctccactctgagggacaggactttggcgctgcccgtcttgctgcggggtggggggagaagtgtgcttgtttcttttcttttttagaattggtttttttggaattatccgccacgaggcagcttcctctccctctcccaggtatttgcacaatatttgtgcggggcgtaggggcgaggttttaagaagtcttttctttgtggacaagcacggggatctcactggacttggtgtggggggctgggggaccccccgtgcagcccttgctggctagtcccctctgggtccccggaggaggcatggcccgcatgaaccggcctgcgcctgtggaggtgagctaccggcacatgcgcttcctcatcacccacaaccccagcaatgccaccctcagcacgttcatcgaggacctgaagaagtacggggctaccactgtggtgcgcgtgtgtgaagtgacctatgacaagacccccctggagaaggacggcatcactgttgtggactggccctttgatgatggagcgccccctcctggcaaagtggtagaggactggctgagcctgctgaaggccaagttctacaatgacccgggaagctgcgtagctgtgcactgtgtggcgggcctgggaagggccccagtgctcgtggctctcgccctcatcgagagcgggatgaagtacgaggacgccatccagttcatccgacagaagcgccgtggggccatcaacagcaagcagctcacctacctggagaagtaccggcctaagcagagactgaggttcaaagacccacacacgcacaagaccagatgctgcgtcatgtagctcaggccctggccctgtacctcattacatctgtgtctaaggagtccaacggctatgtgcgtccctgctctgtccccatctgtacccacggctgtctttctgaagctgtccctggaccctctgccagtcctgtccaacccctgtccctcaccccccactgcccaggccttccccctggcctgtgtattgcaggtgggagtttttaaaccactgggcccaatgcctcagcggcgtggccctcaccctaacctttttccagcacctttgttaccaggtgctctggactctcaaggcaataaatcaggagctgtggatgtgtgtgaagagtgttatagagcaggggaatagggtgtggatcccgggaggccatggtctccatctcttctgtcctattgctgctgctgctactgctgctgcagtggcgtgcctccatggcgccctctggtggccatcccttgctctgcctccctgacttgttctacaagttcttgacgcaaaaatcagcacagcttggactggtgacggtttgtaacattaggaggtgagactgatcacctctgcaggacagagtagggggtcacttggaactttcagtggcctccacccccgaccttcatgcaaccagaggtgtgggttgcaggtagatctgagtgtagatggcctttggtgacatgggtctgcctaggacctcatcctgcttataagttctgagcagtgggctgactcttcccttagctgaggaaagggtatcatgagggacagggctggctatatgtgtgtcttagccagggttttatggctgtgaacagacaccgggaccaaggcaactcttacaaggacaacatttagttggggctgccttacaggttcagaggttcagtctgtcatcaaggtgggagcatggcagcatccatgcaggcatggggcagctgtagctgagagctctacaccttcatctgaaggctactagtggaagactgatttccagggagctagaatgagggccttaaagcccatgcccacagtgacacacctactccaacaaggtcagacctccaaacggtgccactccccaggccagtcgtatttaaacagtgacaatgtgtcagtgtggatgtgctggctgtcttatagcactgacatacttaggacgtgatcctcaggcctttgcagacccagtcccctctgtgcccagaacagagatccagggcgcctctcactggtacctgctgcctgcttgcatcattccctcttcaagttccacctagctctggactaggtcccagaaaccatccgggcccacgtagactcccagcagtccctgttcttgcctgtcctagtagggagtgacaaggtgtagccaaactcagtaatggtgaccttgtgtgggctggaaactcactaccccggtgccatatttccacaaagtcactggtttttgtttttgttttagtctgccaagctttttttttttttaaaagatttatttattttatgtatatgaatatactgtagctgtacagatggttgtgagccttcatgtggttgtcgggaattgaatttaggacctctgcttgctctggtcaactccgctcactccggttcgccaatctctctcagtccttgctagcttcggcccaaagatttatttattatacataagtacactgttgctgtcttcagacataccagaagaggacgccagatctcattaccggtggttgtgagccaccatgtggttgctgagatttgaactcaggactttcggaagagccatctgaccagccccaagcttttttatttttattttttaaatctttaaatttaaaaaaaattattatttgtttgctgt

SEQ ID NO: 280 - DNA, 902 bp, Mus musculus
gttttttgaaccttgcaaacacgatggtgacgaggaacgccttgccaggctcccccagacacgtctgtggttgtaggctatgaatgttaaatgcacactggggaatgtgtttcctatcgcctccccacccaccactgtctgtggggcctaaaaaaaggctctcaaggaaaaacaaaacctaaaacaaacaaaataaagtgtttccctgcattggctggaataggatctcatctgaaaggctggaggacagcaggagtcacgctgcctcccgggccacagccgacttgctcaggtagggccctagctctgcacaaggaaggcgagttactactgtgtccttccgcagaagttgtacaagaaaggatccaacgtgaactcaaaaaggaaaacaaacaagtcccaactcccacagcagccccatctgcagtgaaagacctgcaaaagcaaagtcggaggaagaggctaggaccccgcagtctaccccgcctagtgtataaaaagtgggggcttgcccccttttcccaccccatgagaagcatgagaacgcggagctgaacagagagcttgaagcggggctccactgggccggtggacgagggcccagagccaggtctgcagtcccgcctacttgccccggtgttctgggctcttctgactggtgtggcaatgttcccgaaatgcttgtgatcccagtgggttgtgctctgccggaacagcatccgtgcaggaggctggacgatggtggtattggtcagaggagctgggtccctcggaagcccgcggggaacgtcgaggaagggggcggggtacgtgctagggacaaagtgccggggtttccgggccccggtgcagtggtttggtcccgttggcctggggcgcgggggggggtcccggggaatttc

SEQ ID NO: 281 - DNA, 3908 bp, Mus musculus
gtgggaagcgcggggacccggagccgggccagagagacgccccgaccgcctcggagcagggcgcaccatgcagcgtccgtgtgccggaaagaaaactgagaatgaaattactttggcaagctaaaatgagctcgattcaggactggggtgaagaggtagaggaaggagctgtttaccatgtcaccctcaaaagagtccagattcaacaggcggccaataaaggagcgagatggctaggggttgaaggggaccagctgcctccaggacacacagtcagtcagtacgagacctgcaagatcaggaccatcaaagctggtacgctggagaagcttgtggagaacctgctgacggcttttggggacaatgactttacctacatcagcatctttttgtcgacatacagaggctttgcctcgactaaggaagtgctggagctgctgctggacaggtatggaaacctgacaggcccaaactgtgaagacgatggaagccaaagttcacccgagtccaaggccgtgatccggaatgccattgcttccatcctgagggcctggcttgaccagtgtgcggaagacttccgggagccccctcacttcccttgccttcagaagctgctggagtacctcaaacagatgatgcctggctctgacccagagaggagagcacagaaccttcttgaacagtttcaaaagcaggacgtggattccgacaatggacttctcaacaccagctccttcagcctggaagaggaagaggaactggagagcggagggtcagcagaattcacgaacttctcagaagatctcgtggcagaacagctgacctacatggacgcacaactattcaagaaggtagtgcctcaccattgcctgggctgtatttggtctcagcgggataaaaaggaaaacaagcatttggctcctacgatccgtgccaccatctctcagtttaatacgctcaccaagtgtgttgtcagcaccgtcctggggagcaaggaactcaaaactcagcagcgagccagagtcatcgagaagtggatcaacattgctcacgaatgtagaatcctgaagaatttttcctccttgagggccatcgtttccgcactgcagtctaattccatctatcggttgaaaaaggcttgggctgctgtcccgaaggacagaatgctgatgtttgaagaactttcagatatcttctctgatcacaataaccatctaaccagtcgggagctactaatgaaggaaggaacttcaaaatttgcaaacctggacagcagcgtgaaagaaaaccagaagcggacccagaggcgcctgcaactgcagaaggatatgggtgtgatgcagggtaccgtgccttacctgggcaccttcctgactgacctgaccatgctggacactgccctgcaggactacattgagggtggactgatcaacttcgagaaaagaagaagggaatttgaagtcattgcccagataaagctcctacagtctgcttgcaacagctactgcatgggcccagaccagaagtttatccagtggttccagaggcagcagcttctatcagaggaggaaagctacgccctctcgtgtgagattgaagccgctgccgacgccaacaccacttcccctaagcctcggaaaagcatggtgaagaggctgagcctgctatttctggggtctgacatcatccccgggagcactcccaccaaagagcagcccaagtccgcagccagtgggagctctggggagagtatggactcagtcagtgtgtcgtcctgtgaatcaaaccactccgaggctgaggagggccccgtcacacccatggacacaccagatgagccccaaaagaagctctctgaatcctcctcttcctgttcctccatccattccatggacacgaattcctcagggatgtcgtccctaatcaaccccctgtcctcccctccaacgtgcaacaacaatcctaaaatccacaagcgctccgtctccgtgacatccattacctccacagtactgcctcctgtttacaatcagcagaacgaagacacctgcatcatccgcatcagtgtagaagacaacaatggcaacatgtacaagagcatcatgctgacaagccaggataagacccccgctgtgatccagagagcgatgtcgaagcacaacctggagtcggaccccgccgaggagtatgagctggtgcaggtcatctcggaggacaaagaactagtgatcccggactctgcaaacgtcttttacgccatgaatagccaagtgaactttgatttcattttacgcaaaaagaactcggtggaggagcaggtgaagttgcgcagtcggaccagcctgactttgcccaggacagctaagcggggctgctggagtaacaggcacagcaagatcaccctctgaaagggacagtacactcctactgcccaaggcagagtgaggctgagcaaaagccatggcgacgccaaccaccacccagtgttgagcatcattggtgaaagcgacagatatttatagaattcagctgtgcagagagcactgtgcaggggagagtggaagtgaatttgacattaaaaggataaaaggttcactgatgctcttagatctgagagtgaatacaaaatagtccatattttaaaatatatatacacacgcatatcgtgtgtgtatgcgtgtgtttgtatgtgtgtgtgtgtgtgtgtgtgtgtgtgtgtgtgtgtgtatgtagatataccagagggactatacaggatattctggactatggaaaaaccaatttgcacaatggcctgggaagttgaggtcactttttacagggaaacagaagggaccaagaacctggtctcatacttccaagtaaatagaattagaactaccaatgcggagtgttcttcatgccagtattacaagcccaggctcttatttttgtaaagggagagaattcctttctcagtcatgtgccaccagatgaccaaacagcagagattgacatggccataggctgcatgaaaggccaccatggaaaggttcggatgggtcagtggtctctgccccctgctggagtctgctggagcatctgaggcctgtgtgccttgctggtccccgtcacaatgcccctggggtcaacacaagcttgtttcaattcctggaaaccctgttgtgtttctgcattctctcctgaggaacgcaccacaatcattaccacacaggtagcctcggtcttccataacttttcagccagagaagaaagcgcagaagcacagcaactcctctggactctcctctgtcttggaccactccaccaccctctgattgcctttgcatgtagcagtgtacatccggtcgtttgccatctttagctgtgggcctctgtcttatgagcagttcttcctcaggtgtagacatttctgctgcagtcaactccatgcaatcatttcaagcctgtgaaagatttctgagcagcaaccccccccccccccccccggtcaacccctcagaaactgtctcccactgactaacagcggctcctgtttccttctttactttagtagcattcctgtgttcaggtcacagggagagaaaggagactgcgactgccgtctctgtcctttctcacagaggtgcacccttatagaagggaagagtcgcgctcttctttctcacctctcacttactctcttggtggcgctggtaagtgatgggttttgtctgtaataacagtttcattctgtgcttccgatctgcgctatgctgggatctgaatggaaaagccatacatgaaggagctgacatgtataagaagcactttcaaattattgtccctttttaatttttttctccaaataccagtttttattccaaaaataaagagaatgaacccagaatacgaaaaaaaaaaaaaaa

SEQ ID NO: 282 - DNA, 275 bp, Mus musculus
atttgagaacatttttaataaataatatgacaaaattacttttctgattattgaattttcagtatgcaaaagtatggctaaaaataaagaggtttcttacatgaacataatgaaaacattaatcacgtggattgttcccttagaactgcacatcctttctatgggacatggggcttcttcaaattagctaaatgaatacacttagttttaggtgaataccagccttttgtttttatttgcttttatttatttatttatttatttatttatttatt

SEQ ID NO: 283 - DNA, 3723 bp, Mus musculus
aagatggcggcagaagcagctggtgggaaatacaggagcacagtcagcaaaagcaaagacccctcggggctgctcatctcggtgatcaggactctgtctaccagtgatgatgttgaagaccgagaaaatgagaaaggtcgccttgaagaagcctatgagaagtgtgaccgtgacctggatgaattgatcgttcagcactacacagaattgaccacagccattcgcacataccagagtatcacagaacgcatcactaactcgaggaataaaatcaagcaggtcaaagagaatctgctttcctgcaagatgctgctgcattgcaaacgggatgagcttcgtaagctgtggattgaaggaatcgagcataagcacgtcctgaacctactggatgagattgagaacatcaagcaagtgcctcaaaagctggaacagtgcatggccagcaagcactacctcagcgccaccgacatgctggtgtcagcagtggagtccctggagggtccactgctccaggtggaagggctcagtgatctcaggctggaacttcacagcaagaagatgaacctgcacttggttctcatagaggaactgcaccgccatctgtatatcaaatccactagccgggtggtacagcgtaacaaggaaaaggggaagatgagttctcatggcaaagatccctctcctggtcctctgattgatgtttcaaacatccctactccacgcaaattccttgatgcttctcaatattctgctgctggaggctcaagtgtgagggagatgaacctgcaagacgtcaaggaggacttggagtgtgacccagaggagaacagcactcttttcatgggaattcttattcagggcctggccagactgaagaagatccctgagacagttaaagccattaaagagcgtctggagcaggagctaaagcagattgtgaagaggtcaaccacccaggtagcagacagtgcttatcagaggggagagagcctcactgtggacaatcagccaaggttactcctagaactgctggaactgttgtttgataagtttaatgccgtagccactgcacactcagtggtcctggggtacctccaggactctgttgggacccagctaacacagcaggaggagatcaaattatatgacatggcagatgtgtgggtgaagatccaggatgtgctgcagatgctgttgactgagtacttggatatgaagaacacacgcaccgcctcagagccatcagcccaactaagctatgccagtactggacgagagttcgcagccttttttgccaagaagaaaccacagaggccaaagaattctcttttcaagtttgaatcatcctcccatgctatcagcatgagcgcctatctccgagaacaaagaagggagctctacagtcggagtggagaactccagggaggtcctgatgacaacttaattgaaggtggaggaacaaaatttgtctgcaaacctggagccagaaatattaccgtcatattccatccattactgagatttattcaggagattgaacatgccctgggacttggccctgccaaacagtgtcctcttcgagagtttcttaccgtgtatatcaagagcatcttccttaatcaggtcttggctgagatcaacaaggagattgaaggtgtcaccaaaacctcagaccccttgaagatcctggctaatgcagacaccatgaaggttctgggagtgcagcggcctcttctacagagcacaatcatcgtggagaagacagtacaagacctcatgaaccttatgcatgacttgagtgcgtattcagatcagttcctcaacatggtgtgtgtgaagctccaggagtacaaggacacgtgctccacagcctacaggggcattgtccagtcagaagagaaacttgtcatcagtgcatcttgggcaaaggatgatgatatcagcagactcttgaaatcgctgccaaactggactaacatggctcagcccaaacagctaaggcctaagagggaggaggaagaagacttcataagggcagcctttggcaaggagtctgaagtcctgattggaaaccttggtgacaaactcattcctccacaagacattctccgtgacgttagtgacctcaaagccttggccaacatgcacgaaagcctggaatggctggcaggtcgaacaaagtcagctttctccaacctttctacatcccagatgctttcccctgctcaagagagccacgtgaacatggaccttcccccagtgtctgaacagatcatgcagacactgagtgagcttgccaagaccttccaggacatggctgaccgctgcttgctcgtcctgcatctggaagtgagagttcattgtttccactatctcatccctctggcaaaggaggggaactatgccatcgttgccaatgtggagagtatggattacgaccctctagtggtcaagctcaacaaagacatcagtgccatggaagaggccatgagcgccagcctccagcaacataagttccagtacatctttgaaggtctgggacacctcatctcctgtatcctcattaatggggcccaatacttccggcgcatcagtgagtctggcatcaagaaaatgtgtaggaacatttttgttcttcagcagaacttgaccaacatcaccatgtcacgggaggcagacttggactttgcaaggcagtactacgagatgctgtacaacacagccgacgagctcctgaacctggtggtggaccagggtgtgaagtacacagagctagagtacatccatgccctgaccctgctgcaccgaagccagactggtgtgggggaccagaccacccagaacaccaggctgcagagactcaaggagatcatctgtgagcaggctgccatcaagcaagccaccaaggacaagaaaataaccactgtgtgatggagtgcacctcactgggtgtgggtggggttcccagtatgcacggccacagactctagctgctcagcatggcctgagctggctgtgctccatctacactgaggcttagtgggtaggcggtggattattttctctttagttttgctttttcatatgaacgctaagaaagtttgcagtacagaatgttgcctaacaaacactttagtctattctcaagggatgagggtgggacagggaggaggccatgccaagttgctggactctgagaaaggaatgaaggaaagccgactgccacctaagttttaggaccatcctgaaatacttaataaggcctgtggcataagcagtcggctttctctggtcttagccttgtcagtttatagtttagtgtagtaagtatatgcacattgctttgtctccattgccaaaatcaagtaagcgcttctcagctggcttcccagcccaaaacagatctctgtgagcctgggagatagcggtcctttatcccaaccctgggacagactgcacgctctagcaggattgttcgcaggctgctggtttggttttacaagcttcttgttttattccttctgtattaaaaccagttaagagcagtgactgtccttccagaggaccagggttcaagtctcaacacccgcaaacagaggctcataaccctctgtaacttcagcttcatctgacctgaggccctcgtagtactacatgcacgtggtgcacagacatacatgcaggcaaaaatactcatacacacaaagtaaaaaaaaaaaaaaa

SEQ ID NO: 284 - DNA, 3723 bp, Mus musculus; identical to SEQ ID NO: 283

SEQ ID NO: 285 - DNA, 396 bp, Mus musculus
tcacgtactccatcccgtcctccctcctccactaccttcaccatcctatccctaaatcaccttacccctaatccacccgttacctgatcctcctttcaccctcgccccttacacatttcacaccctataggcaaaccctagcatagagtgctagagccacatctcagtgctcggattcggtattcaactctccactccctgtgcccagttgggatttaaaaactcagattgccatggcaaggggctttgctgggaaaggcgactcctctaacttcacctcttcagttcctccagtggagtttttacatttcccaatgcccatcttgtgaatatcttcatacatactttctattaatgttactgtagtttctgttttgaaataaaacttctgaatcc

SEQ ID NO: 286 - DNA, 630 bp, Mus musculus
  modified_base (68)..(68): a, c, g, t, unknown or other
cagaaaactgtggagcgcctcctgtggaatgggccacttcctaggcatctgtgcattccacacagtcncaggtcatcctgcagatgagagctctcctccccataagaaagaggactaaaggaagctcatgttaccaacaagccttgcctagaaattggtatcaaatattttatataaagaaatgcttgtgtgtatatgccatatttattaataattgtaactaaagtcactgacctatagacagtaccaggttaaatattgggatatgtatgggcaatcagaaatgttactttaaatgccatctgcctattttgaggccatgtttggcactttttagactagggtaagtctgataatacctggtggggttttgtcttttttttttttttttgtctgaactctcaaagtttgttactggaaattatttgcatggtaggagagattgaattatttattttttatatgtagaaaaatctctctaaccaacaaatagctcattgttactgatttgtttgttttcctaacttattctcctggacagaacggtagcaaagttttgttcagctgaataaatgcactcagctaataaaccaaaatttattctttcaaaataagaaattatctgttatc

SEQ ID NO: 287 - DNA, 1559 bp, Mus musculus
cctttctggtgctggaactgaacctgggtcttgtagaagagcagcaagtgctcttacctaccaagctctctctccagccccatgtggtggtgttgtgttttgtttgtagtagaatgccctcgaggactgctcccacggccatgcagagtgctggtgctgctgaacccccagggtggcaagggcaaggctctgcagctcttccagagccgtgtgcagcccttcctggaggaggcagagataacctttaaactgatactcaccgaacggaagaaccatgccagggagctggtgtgtgcagaggagttgggtcactgggacgccctggcagtcatgtccggtgatggtctgatgcatgaagtggtgaatgggctaatggaacggccagactgggagactgccatccagaaacccctgtgtagcctccctggaggctccggcaatgcgctggcagcttctgtgaaccactatgctgggtacgagcaggtgactaatgaagacctgctcatcaactgcacactgctgttgtgccgccggcgcctgtcacccatgaacctgctgtccctgcacactgcttctgggctgcggctctattctgtgctcagtctgtcctggggctttgttgctgacgtggacctcgagagtgagaagtacaggcgcttgggggagattcgtttcacagtgggcaccttctttcgcctagcaagcctgcgcatctaccaaggccaactggcctaccttcctgtaggaactgtggcctctaagagacccgcctctacactggtgcagaagggccccgtcgacacacaccttgttcctctggaggagccagtgccttctcattggactgtggtaccagaacaggacttcgtcctggtgctggtgctgctacacacccacctgagctccgagctgtttgcagcacccatgggccgctgtgaagctggtgttatgcatctgttctacgtacgtgcgggggtgtcaagggctgcgctgctgcgcctcttcctggccatgcagaagggcaagcatatggaacttgactgtccatacctggttcatgtgcccgtggttgctttccgcctggagcccaggagccagaggggcgtgttttctgtggatggagagctgatggtatgtgaagctgtgcagggccaagtgcacccaaactacctttggatggtctgtggcagcagagatgccccatccggccgggactcccggcgggggccacctccagaagaaccataactctgtgcctttgtctactctgtctaggctgagatgggaccctcccccgcacccacttcctggtatgggaggttatttctaaagttcctatggaagtggtggggacccctgcagagaaagctagaaggtggggctatgacttggaaagaaaggctctaccttccagttagagtaacatccccagtagagccctgctggctggaccagttgcatatagaagacactccccattgctcttagggaccttccctgggaaccaaattcaaataaagagacttttccaaaaaaaaaaaaaaaaaaaaaaaaaaaaa

SEQ ID NO: 288 - DNA, 3142 bp, Mus musculus
gtcgccgcgacaagaatccagaacttttctgggagtgaggaaatccagagaacttttttaggagtgaggggacagccatccttcgtggcttttgggagctgaagccgcagggtttcggatgagctgacaccatggagcctccaggacccagcacgcccacagcctctgccgctgcccgggcagatcactacaccccaggcctccggccactcccgaagcgcagacttctatatagctttgcgttgctgcttgctgtgctacaggctgtctttgttccagtaacagctaacccagcccataatcgtccagctggcctacagcggccggaggagagcccatcaagaggaccctgtctagcaggccagtacctgtcagaagggaactgcaagccttgcagagagggtattgactacaccagccattccaaccattctctggattcatgtattctctgcacagtctgtaaggaagataaagtcgtagaaacccgatgcaacataaccacaaatacggtgtgtcgatgcaaaccaggcacctttgaagataaagactcccctgagatctgccagtcatgctctaactgcactgacggggaagaggaactgacttcctgtacccccagagaaaaccggaagtgtgtctccaaaacggcttgggcatcttggcataagctaggcctctggataggactcctggttccagtagtgctgctgattggagctctgcttgtctggaagactggagcatggaggcaatggttgctctgtataaaaagaggctgtgaacgggatcccgaaagtgcgaactctgtgcattcgtctctcttggaccgacagacatctagcacgacaaatgactctaaccacaacacggaacctggcaagactcagaaaacaggaaagaagttgctggttccggtaaacggaaacgactcagctgacgacctgaagtttatcttcgagtattgttcggacatagtgccctttgactcctggaaccgtctcatgcggcagttgggcctcacagacaatcaaatccaaatggtcaaagccgaaacactggtcacacgtgaggccctgtaccaaatgctgctcaagtggcgccaccagactgggcgaagtgcctccatcaaccatctgctggatgccttggaagccgtggaagagagagatgccatggagaaaattgaagactacgcagtgaaatccgggaggtttacttatcagaacgctgcagcccaaccagagacagggccaggaggatctcagtgcgtttgaagtcagcctgatctacttagtgaactcaggacagccaaggctatgtagagagccccgaagatgcaggctcttcagtattatgagaatgtacttaattttttcttgtagtagttagtgtatcatattattgtattatttatattattactgttaagtactatgttctcttattagaagttgaacacagaacctctgagaacacatatgctacaagtgttctaacacacctccagcatcccggattacctttgttcctgaacaaggcacaattggtagggtatgatagggcctgcctatcatcctaacactccggtgatggagccaggaagatcaagagttcgaggccagctggttcacataagatcccatataatgtgcaggatggctaaacttgctgagagctgactctgtggtctcctgtcccagattctagcgatattcattactaagacccttgtccagagacaaaagaccacctctgtaacagagggaagaataaaacagccctagggtggaaactccttgtgaacacagccactgctgtttactgttagactactgctcagcactacacagctgcacggcacctccctgtgccaggtgctagtgggcagcctactgagggtacatctaacttgaatctaacacacttgaagtgagtttgctggtttggacacagagggagcattaagtgctacctggggtgacccttgaggaccacgccccctgtaagcatttgaccattgtgagagtaaacactgaaactcaccattgtcctgcctcagcctttctagagctggaatcataggtatgctgcaccggatccagaaggagaaataactacctttagatactgtgatagggatttctagaaagctgccacatacagatttttgtcctgtgtgaattcctattgttttttgtttgtttttaattttttattatttattttcttcattcacatttcaaatgctatcccaaaagtcccctatgccctccccccccctgccccccgccctgctcccctacccactcactcactcccacttttttttttttttttgagacagggtttctctgtgtagccctggctgtcctggaactcactctgtagaccaggctggcctcgaactcagaaattcacctgcctctgcctcccaagtgctgggattaaaggtgtgtgccaccatgcccggccttttttttttttttttttaattaggtatttatttcatttaaatttccaatgctatcccaaaagtcccccacatgctcccccacccactccccacctgactttatatgcctcactcccacttcttggccctggtgttcccctgtactggggcatataacgtttgcaagaccaaggggcgtctctttccactgatggccgactaggccatcttctgatacatatgcagctagagacacgagctctgggggggtactggttagttcatattgttgttccacctatagggttgccgaccccttcagctccttgggtactttctctagctcctccactaggggccctgtgttctatccaatagatgactgtgagcatccacttctgtatttgccaggcactggcatagcctcatacgagacagctatatcagggtccagttttgttttgttttgttttaaactagcatgctggagaggtagctcagcggttaagagcagtggctgctcttccagaggtcctgagttccaattcccagcagctacatagtggctcacaaccttctctaatgggatctgatgtccttttctagtgtgtttgaagccagtggcagtgtaattacatacacaaaataaataaatctttttaaaaaagaaaaaaaaaaaaaaaaaaa

SEQ ID NO: 289 - DNA, 332 bp, Mus musculus
cactctccggaggagttcccagggctcctggttcagcaactacacacctcaaggtgcgggaagaaatgcccttcaataaccgattgtatctggtacatattgtgtgatacttgaagagataaaagggactcaccaccccttaattgaaatttaagctttttaccgctttcccctccttcccctctatcctcccttctcccctccttgcattgtgatgatctagtgggcatgtctgtcacctggacaattgcctcttctgactataacctcttaatagttgtgtataatgaaaactgtaaacttttttaaataaaatgtgtatataccttgcc

SEQ ID NO: 290 - DNA, 321 bp, Mus musculus
tcttttcgggctgcgtctcagtatagtgacacatgaacctgcgcccctccaatccccgaacgttattaactctttgactgattcccagatgtgtgtgtgtgtctgtgttcacgcccgcgtggggatctgtgtggatgtgtgcacgcacacttaagtgcatgcatggaaggtgcctgggctgtctttgctatatgtaaatagggccactggatttttatttttgattaatttgttctgatttttttttggtttgttttttaagggactgtaatgaacaaatgtcaggatacccaatgccaaataaagatgatgtatttattt

SEQ ID NO: 291 - DNA, 2824 bp, Mus musculus
tcgacggtatcgataagcttgatatcgaattcggcacgagaggcaactatggtgaagatgatcatgtagaccaagtaacaggcgaagttgaagaagaatcttgggatgagccgatcccatttctcctgcagaagcttgttcagtgactataaaaccaacaaagaaacacaaacacaagcagaagatgcttagaactaaggtggagggtggacgatacagagaaagctacggccagctacggaggcttccgcggcacttcctctctcaatccccgctgctggagagtcccgctaggcttggtgatcccggcttgtagtctgctgccgctacgccttgacttcagcctgaggggtcccagccaggcctaccccactgcggtatgagagagagagggaacttaagatctccatctccacagaagtttcagcgataaggagcaccctcctctctcaggatgacttcagcctccaaccccccagcttttaggctggagacgtccgatggagatgaagaaggcagtgctgaggtgaacaaaggaaagaatgagccaccccccatggagtctcccttccagggagaggaccggaacttctcccctcagattaaagtgaatctcaactaccgaaagggactgggtcccagccaacaggacccaaatcggtttgaccgtgaccgactcttcagtgtggtctcccggggtgtccccgaggagctgactggactgctagagtacctgcgccggaccagcaagtacctcactgactcggcatacacagaaggctccactggaaagacgtgcctgatgaaggctgtgctgaaccttcaggatggggtcaatgcctgtatcctgccgctgctgcagattgacagggattccggcaatcctcagccccttgtcaatgcccagtgcaccgatgagttctaccgaggccacagtgcgctgcacatcgccatagagaagaggagcctgtggtgcgtgaagctgctggtagagaatggagcgaatgttcacatccgagcctgtggccgcttcttccaaaagcaccaaggaacttgtttctattttggagagctacctctttctctggcagcgtgcaccaagcagtgggatgtggtgacctacctcctggagaacccacaccagcctgccagcctggaggccaccgactccctgggcaacacagtcctgcatgctctggtaatgattgcagacaactcacctgagaacagtgcgctggtgatccacatgtatgacagccttctccaaatgggggcccgcctctgccccactgtacagcttgaggatatctgcaaccatcaaggcttaacacccctgaagttggctgccaaggaaggtaaaattgagatcttcaggcacatcctgcagcgggagttctcagggctgtaccagcccctttcccgaaagttcaccgagtggtgctacggtcctgtccgagtgtcactgtacgacctgtcctctgtggacagttgggaaaagaactcggtcctggaaatcatcgctttccattgcaagagcccgcaccggcaccgcatggtggttttagagccactgaacaagcttctgcaggagaaatgggatcggctcatcccaagattcttcttcaacttcgcctgttacttggtctacatgatcatcttcaccatagttgcctaccaccagccttccctggagcagccagccattccctcatcaaaagcgacttttggggactccatgctgctgttgggccacattctgatcctgcttgggggtatttacctcttactgggccagctgtggtacttttggcggcggcgcctgttcatctggatctcgttcatggacagttactttgaaatcctcttccttgtccaggcgctgctcacagtgctgtcccaggtgctgcgcttcgtggagactgaatggtacctccccctgttagtgtcatccctagtgctgggctggctgaacctgctttattatacacgtggctttcagcacacaggcatctacagtgtcatgatccaaaaggtcattctgcgagacctgctccgcttcctgctggtctacctagtcttccttttcggctttgctgtagccctagtaagcttgagccgggaggcccgaagtcccaaagcccctgaaaatagcaacaccactgtgacggaaaagcccacgctgggtcaggaggaggagccagtcccatatgggggcattctggatgcctccctagagctgttcaagttcaccattggtatgggtgagctggctttccaggaacagctgcgctttcgtggggtggtgctgctgttgctgttggcctacgtcctcctcacctacgtcctactgctcaacatgctcattgccctcatgagtgagactgtcaacagcgttgccactgacagctggagcatctggaagttgcagaaagccatctctgtcttggagatggagaatggttactggtggtgcaggaggaaaaggcatcgcgcagggaggctgctgaaagttggcaccaaaggggatggtatacctgatgagcgctggtgcttcagggtggaggaagtaaactgggctgcatgggagaagacccttcccaccttatctgaggatccatcaggggcaggcatcactggttataaaaagaacccaacctctaaacctgggaagaacagtgcctcagaggaagaccatctgcctcttcaggtcctccagtcccactgacggtccagatgcggcagcagcaggctggcagggtagagtagggaattttgccagccacacccgaggctactgaattttggtggaaatataaatattttt

SEQ ID NO: 292 - DNA, 1734 bp, Mus musculus
cccacgcgtccgcgctcctgatctccagaggaccccgggctgggacaggggccttggcgaggctgcagctgctgtggcagtagcttgggatggaggtctttcttgctgggaactgaggagctgagaggctcctgtcaggctcctgtcctaaactcttggcacttgcggtggcttgggcttcacacactgtcagacaccttcttggtggcctcctcggcctcaggtttgaagctggctccacaagggacacggtgacatgaggggcaacccactgatccatcttctggccatttccttcctctgcattctctcaatggtgtattcccagctgtgcccagcaccctgtgcctgtccttggacaccaccccagtgcccaccgggggtacccctggtgctggatggctgtggctgctgtcgagtgtgtgcacggaggctgggggagtcctgcgaccacctgcatgtctgcgaccccagccagggcctggtttgtcagcctggggcaggccccagtggccgtggtgctgtgtgcctcttcgaagaggatgacgggagctgtgaggtgaatggccgcaggtacctggatggggagacctttaaacccaattgcagggttttgtgccgctgtgatgacggtggtttcacctgcctgccgctgtgcagtgaggatgtgcggctgcccagctgggactgcccacgccccaggagaatacaggtgccaggaaggtgctgccccgagtgggtgtgtgaccaggcagtgatgcagccggcaatccagccctcctcagcccaaggacaccaactttctgcccttgtcactcctgcatctgccgatggcccctgtccaaactggagcacagcctggggcccctgctcaaccacctgtgggttgggcatagccacccgagtatccaaccagaaccgattctgccaactggagatccagcgtcgcctgtgtctgtccagaccctgcctggcatccaggagccacggctcatggaacagtgccttctagagccattgcggggatgtggatacagggcctgccattctcagcaaatgtccctaggaccaggccctggactgatggtagatgcccctctccatgctcttggctgcagttaactgtcctgggtggattcagtgtccagagcctctgagcgatccctgctctgtctgaggtgggggaagcaggtgaccagctccatttctctggattctgacccaggcttctgggttctcctggctagttcctcaaaacttccctgtatgaaaaggacaaccaaaaggacctttaaagctaagctgtactgggcaagcctggccaccatgctggggatagtgacagtaataggtaccaggcagcagattgcctgaaacatccaggtcccttcttggacttctatgtgcttgtcccaaagattatgggtgaccttgtaagtgtgcctttcctgatctgagaacaccctgcccggctgggaagaattttctgggaacatgaagagatggaatcacactattcttaagagcgtttgccaagtccaggaacttgacctttgtatttgtaaaaatacacatctcttaaatgctcacaaagcaagaggctccacacttctggcaggccagggcctttctcttcagcatgagagagacaaggaacagtagagtaccctcctctggaggactggcccggtctggaataaacacccaaatcaagtgtggaaaaaaaaaaaaaaa

SEQ ID NO: 293 - DNA, 635 bp, Mus musculus
  modified_base (21)..(21): a, c, g, t, unknown or other
  modified_base (26)..(26): a, c, g, t, unknown or other
  modified_base (67)..(67): a, c, g, t, unknown or other
atcctaagaagataatcaaantatcntaaaggaaagcatcaccattctcctatgttaagtaatttanaacaaatatttaatagcttacatgtatttttaagtgactcttattttttaaatacaaaacaacatttagaggctgggtgtaattcagtggtacagaattgtcctagaatttaggattctctagctttggtccccagcactgccaaaaaccaatataaaggtagcagagaagaagccagtttcaagaatggtccacagggtgagcatgcatagtgttaagattaaggctgaatgtcgataggttaccatcacatctttactagtgcataggaggaatacagtgtgtcttgttttcttattcttggcattaatctaatatactgataaacactcaccttctgagtagaatggcttgtattggcagtgtttgtgttagcaatctagcctttgtaatgtgaactttcaaccctagcattcttgctttggggtcttcttcctttctttttggtaagttttctgaagttggaatatagtgtgttagaggtgtgtgtaaaactattttgcatggttttcttttcctttattttccttttctttctttttggtccgtgtggattctttttagcaaa

SEQ ID NO: 294 - DNA, 2433 bp, Mus musculus
gaattcggcacgagcacagcctggccaggcagcaaggaacgcagcagaggaagccaccgctgtcagcaccagtatgtcttacagtgtgactctgactgggcctgggccctggggcttccgtctgcagggaggcaaggacttcaacatgcccctcactatctcccggatcactccaggcagcaaggcagcccagtcccagctcagccaaggagacctggtggtggccattgatggcgtcaacacagacaccatgacccacctggaggcccagaacaagatcaagtcggccagctacaacctgagcctcactctacagaagtccaagcggcctattcccatctccacgacagcgcctcccatccagtccccgctgccagtgatcccccaccagaaggaccctgctctggacacgaacggcagcctggcgactcccagccccagccctgaggcaagggccagcccaggcgccctggagttcggggacacctttagctcctccttctcccagacctctgtctgcagcccactcatggaggcctcggggcctgtccttcctctgggtagcccagtggccaaggccagctcagagggtgcacagggctcagtcagccccaaagttctgccaggccccagccaaccgaggcaatataacaaccccattggcctgtactcagcagagaccctgagggagatggctcagatgtatcagatgagcctccgagggaaggcctcaggtgctggactcctaggagggagcctccctgtgaaagacttggcggtggacagcgcctctcctgtgtaccaggctgtgatcaaaacccaaagcaagccggaagatgaggctgatgagtgggcccgccggtcctccaacctgcagtctcgctccttccgcatcctggcccagatgaccgggacagaatacatgcaagaccctgatgaagaggctctgcgaaggtcaagcacccctattgagcatgctccagtgtgcaccagccaggccacttccccgctgctgcctgcttctgcccagtcgcccgctgctgcctctcccattgcggcctcgccaaccctggccacagctgctgccacccatgctgctgccgcctctgctgcaggccctgccgcaagtcccgtggagaatccgaggccacaggcctctgcttacagtcctgcagccgccgcttctccagcaccctctgcccataccagctacagcgagggtccagctgcccctgcacccaagcctcgggtcgtaaccactgccagcatccggccttctgtctaccagccagtgcctgcatcttcctacagcccatctccaggagccaattacagtccaactccctataccccttcgccagctcctgcttataccccctctcctgctcccacctataccccctcacctgcacctacatacaccccttcccctgcaccagcttataccccctcacctgccccaaactatacccctacaccatcagctgcctacagtgggggcccttcagaatctgccagccgtccaccctgggtgaccgatgacagcttctctcagaagtttgctcctggaaagagcactaccactgtcagcaagcagaccctgccccggggggctccagcctacaacccaacaggtccacaagtgacacctcttgccaggggcaccttccagagagctgagcgcttcccagctagcagccggactcccctctgtgggcactgtaacaatgtcatcaggggcccttttctggtggccatgggccgctcttggcacccagaagagttcaattgtgcctactgcaagacctccctagcagatgtgtgctttgtggaggagcagaacaacgtttactgcgagcggtgttacgagcagttctttgccccgatctgtgccaaatgtaacaccaaaatcatgggggaagtgatgcacgctctgcgacagacatggcacaccacctgctttgtctgtgcagcctgcaagaagccctttgggaacagcctcttccacatggaggatggagagccatactgtgagaaagactacatcaacctgttcagcaccaagtgccatggatgcgatttccctgtggaagctggtgacaagtttatcgaggccctggggcacacctggcatgacacctgcttcatttgtgcggtctgccacgtgaatctggagggtcagccattctactctaagaaagacaaaccactgtgcaagaagcacgcacatgccatcaacgtgtaggagcccagagtggctggtgtgccaagcccaggctgctcctgctactgatgacgaaggagtcaaagaagctgatgttgtttcttctggtagggaaggggaacgagagaaaatggttgagcccttttgaagtctaactttagtcttttcttgtatacacagattgtgtattattgtagttcagactagaa

SEQ ID NO: 295 - DNA, 6210 bp, Mus musculus
atgctctgttgcttgctggcaagggccagcaacctccccaatgtgaagaaggaccggcgcagcgatccagttgccagcctgatttttcgaggggtaaagaagagaaccaaagtcatcaagaacagtgtgaaccccgtrtggaatgagggctttgagtgggacctcaaaggtattcctctagatcagagctcagaacttctcgtggtggtcaaggaccatgagacgatgggaagaaacaggttcctgggggaagccaagatcccactccaggaggtccttgccacccccagcctctctgccagcttcaacgcacctctgctagacgccaagcagcaacccacgggggcctctctggtcctgcaggtgtcctacacgccacccccaggagctgtgcccctgttcccaccacctgcttctctagcaccctccccgacactgcctgacatggatctggtgcctgacacaggaggggaggaagacaccgaggaccagggcctgactggagatgaagctgagccgttcctggaccagagtgctgctgtgggcccagggggaccgaccacacccaggaagccaccttcccaccctcctccccactatccaggggcaaaaagaaaaagaagctctgccccacctagaaagctgctgtcagacaarccrcaggacttccagatcagrgtccaggtgatagargggcgtcagctgcctggggtgaatattaagcctgtggtyaaggtcacagctgctgggcagaccaagcgaactcggatccagaagggaaatagcccactcttcaatgagactcttttcttcaacgtatttgactctcccttggagctgtttgatgagcccatcttcatcacggtggtggactcacgctcccttaggacagatgccctccttggcgarttccggatggatgtgggcaccgtgtacagagagccccgacacgcttatctccggaagtggctgctgctctccgaccctgatgayttytctgcgggggccagaggctacctcaaagccagcctktgtgtgctrgggcctggagatgaagctcccctggacaagaaggacccttctgaagacaaagaggacattgaaggcaacctgcttaggcccaccggtgtggcccttcgaggagcccacttctgcctgaagctcttccgggctgaggacttaccacagatggacgatgctgtgatggacaacgtcaagcagatctttggctttgacagcaacaagaagaacttggtggatccctttgtggaagtcagctttgctgggaaaatgctctgcagcaagatcctggagaagacagctaaccctcagtggaaccagaacatcaccttgcctgcgatgtttccctctatgtgtgaaaaaatgaggattcgtgtcatggactgggaccgcctcactcacaatgacattgtggccaccacctacttgggtatgtcgaaaatctctgctactggaggagaaatagaagtggacgacaacctgggcttcctccccacttttgggccctgctatgtgaacctctatggcagtccccgagagttcacgggcttcccagatccttatgcagagctcaacacaggaaagggagaaggtgtggcttatcgaggcagggttctgttgtccctggagaccaaactggtggaacacagtgagcagaaggtggaagaccttcctgcggatgatatcctgcgcgtggagaagtacctgcggaggcgcaaatattccctctttgctgccttctactcagccacaatgctgcaggatgtggatgacgccatccagttcgaggtcagcattgggaactacgggaacaagttcgacaccacctgcctgcccttggcctccaccacccagtacagccgtgcagtctttgacgggtgccactaytactacctaccctggggtaacgtgaaacctgtggtggtgctgtcatcctactgggargacatcagccatagaatcgagactcagaaccagctgcttgggattgctgaccggctggaagctggcctggarcaggtccacctggccctgaaggcgcagtgctccacggargacgtggactcgctggtggctcagytgacrgatgagctcatcgcagactgcagccagcccctgtgtgacatccacgagataccttctgccacccaccttgatcagtacctgctccggctacgcacccgtcacctgagccagatcaaagaagctgctctggccttgaagcttggccatagtgagctctccactgccctggagcaggccgaggactggcttctgcatctccgtgccctggccgaggagccccagaacagcctgccggacatcatcatctggatgctgcagggtgacaagcgtgtggcctaccagcgggtgcctgcccatgaagtcctcttctcccggcggggccccagctactgcggcaggaactgtgggaagctgcagaccatctttctgaaatatcctatggaaggtatgcctggggcccgaatgcccgtgcagattcggatcaagctctggttcgggctctctgtggatgagaaggaattcaatcagtttgctgagggaaagttctctgtctttgccgaaacgtatgagaaccagacaaagttggcaytggtcgggaaytggggcacaacgggcttctchtaccccaagttttctgatgtcacaggcaagatcaaactaccaaaggatagcttccgccccacagctggctgggcctgggcaggagattggttcgtgtgtccagagaagaccctactccatgatgctgccgctggtcatctgagcttcgtggaggaggtgttcgagaaccagacccggctccctgggggccagtggatttacatgagtgataactacacagatgtgaatggggagaaggtacttccgaaggatgatattgaatgcccgctgggctggaagtgggaagatgaagaatggtccacagacctcaatcgggctgttgatgarcaaggctgggagtatagcatcaccatacccccagaccgaaagccaaaacactgggtccctgttgagaagatgtattacactcacaggcgtcgacgctgggtccgactgcgcaggagggacctcagccagatggaagcactgaagaggcacaggcaggcagaggccgagggcgagggctgggagtatgcctctctcttcggctggaagttccacctggagtaccgcaagacagatgccttccgccgccgccgctggcgccgccgcatggagccgctggagaagacgggacctgcagctgtgtttgccctcgagggggccctgggcggcatggtggatgacaagagcgaagactccatgtctgtttctaccctgagctttggcgttaacagacccacaatctcctgcatctttgactatgggaaccgctaccatctgcgctgctacctgtaccaggcccgagacctggcagcaatggacaaggactccttctctgatccctaygccatcgtctccttcctgcatcaaagccagaagacagtggtggagaagaacaccctgaatcccacctgggatcaaaccctcatcttctatgagattgagatcttcggcgagccagccagtatcgccgagcatccgccctgcatcgtggtggagctctatgaccacgacacctatggtgctgacgagttcatgggtcgctgtatttgtcagccaagcctggaacggatgccccgcctggcctggttcccactgacccggggcagccagcctgccggcgagctgctggcagcgttcgagcttatccagagagagaagccagccatccatcacatccctggctttgagatgcatgaaacttcaaggattttggatgagacggaggacacagatttgccttacccaccacctcaaagggaggccaacatctacatggttccccagaacattaagccagctctccaacgtactgccattgagatcctggcctggggcctgcggaacatgaagagctatcagatggccagcatctcttcccccagcctcgtggtggagtgtggtgggcagacagtgcagtcctgtgtcatcagaaaccttcggaagaaccccaactttgatgtctgtactctcttcatggaagtgatgttacccagagaggacctctactgtccacctattgtggtcaaggtcatygataaycgccagtttggccgccggccagttgtgggtcagtgtaccattcgctccctggagaacttcctgtgcgacccatactcagcagagagtccatccccacagggtggcccagatgatgtgagcttactcagccccggggaagatgtgctgattgacatcgatgacaaggagcctctcattcctgtccaggaggaggagttcattgactggtggagcaaattctttgcttcygtcggggagagggaaaagtgtggttcctacctggagaaggattttgacaccttgaaggtctatgacacacagctggagaatgtggaggcttttggaggcctgtccgacttttgtaacaccttcaagctctaccggggcaggactcaggaggagacagatgatccatctgtcatcggagaatttaagggtctcttcaaaatttatcccctyccagaagatccagccatccccatgcccccragacaattccatcagctggctgctcarggtccccaggaatgcttggtccgtatttatatcgtccgagcatttggcttacagcccaaggaccccaatggcaagtgtgacccttacatcaagatctccatagggaagaaatcagtgagtgaccaggataactacatcccttgyaccctggagcctgtattcggaaagatgtttgaactcacctgcactctacctctggagaaggacctgaagatcacactctaygattatgacctgctctccaaggatgagaagattggggagacggtcatagacctggagaacaggctgctgtccaagtttggggctcgctgtgggctcccacagacctgctgtgtctctggaccaaacaagtggagagacaagctccgcccytcccagctyctycacctcttctgccagcagcacaggatcaaggcccccgtgtaccggacagaccgagtgacgtttcaggataaggactacaccattgaggaratagargctggcagactyccaaacccacacctgggcccagtggaggaacgcttagccctgcatgtccttcagcaacaaggcttggttcctgagcatgtggagtcacggcctctttatagtcctctgcagccagatatcgagcaggggaagctacagatgtggattgacatatttccaaaggtgctgggccagcctggacctcccttcaacatcaccccacggaaagctagaaggttttttctgcgttgtattatttggaacacaaaagatgtgatcttggatgacctcagtctcacgggggagaagatgagtgacatctatgtgaaaggctggatggtgggattcgaagaacacaagcagaagacagatgtgcactaccgctccctgggtggggagggcaatttcaactggaggttcgtgtttcccttcgactatctgcctgctgagcaagtctgtgctgttgccaagaaggatgccttctggagactcgacaagacagagagcaagatcccagcacgtgtggtcttccagatctgggacaatgacaaattctcttttgatgactttctgggctctctgcagctggatctcaaccgaatgcccaagccagccaagacggctgagaagtgctccttggaccagctggatgacaccttccacccagaatggtttgtgtccctttttgagcagaagacagtgaaaggatggtggccttgtgtgacagaggagggcgagaagaagatgttggcgggcaagctggaaatgaccttggagattgttgcagaaagtgaacatgaagagcggcctgctggccaaggtcgggatgaacccaacatgaatccgaagctagaggatccaaggcgccccgatacttctttcctgtggttcacctccccgtacaagaccatgaagttcatcttgtggcgacgcttccggtgtgccatcatcctcttcatcatcctcttcatcctcctgctcttcctgggtgtctttgtctacgccttcccgaactatgccgccatgaagctggtgaagccctttcgatga

SEQ ID NO: 296 - DNA, 861 bp, Mus musculus
cgtgttagagacagtgtaagaagtgaggtcagaaagtgatgcgttattttataatggatataaaatatttccaaggactctgagccacgtggagcaacctcaccatcagctcctccatgcttagccaccatggtaccattgatgcttccgtacctacctgtgtgcatctctgtgtcctgtgagcagatgcagttagaattggccatgatgtccatgaagaacattagcttaacataaagagtgtgggcatggctgttcccttcagaaaggtgatgcacagtattatctgtgttcagaggacctgtccaaacctgtgatttgtattcttacttatcttacatataagcacttggttcacataaatatttagtccataattcaaaatcttttttttaactcagtactttaaatggcagtatttaatttcttaacatttatatttgactacaaatctgcagtaaacaaggtaagttgtgtagttgcctggttttcattcccctctttaggagaaaatagacacctcagaagatgtgccctgaggagtcactgcacttaccgtagctgcttctctgtcgtctctgctaattgttgtgggagaaagatttgcagcaattcagaggttgctgcagatgtagtaccacccacaagttcttaccaaaaagcccttcctgctactactttaagaactgaattctgctgggttgtggtggtgcacgcctttaatcccagcactgggaggcagaggcagaggcaggtggatctctgaatttgaggacaacctggtctacagagtgagttccagaaagaacagcctggaccacacagagaaaccctacttcaaaacacaaaaaaaaaaaaaaa

SEQ ID NO: 297 - DNA, 1419 bp, Mus musculus
gtaagggcacatcccgccagcagccgcccagctcgcagacggagcgcaggggagcgggcgtgcgggcggcgaggcgcagggcaccgggtagaggctcggggaggtcgaagcggcgcgcagggttccaagccggcggcgagagagtagcatcgcacgagcctcccggtacccgctgtctgcgaggcggcccgggccgcaggctcgaccgcacagggagcaaggccaaccagctccagggcgcgagaagccggcgctgtagagccgggacagccgggatcgccgcagcctccagagctgtgggaacctcggggtgcccatgacggcggcggcgaccgtgctgaaggagggcgtgctggagaagcgcagcggcgggctgctgcagctgtggaagcggaagcgctgcgtgctcaccgagcgcgggctgcagctcttcgaggccaagggcacgggcggccggcccaaggagctcagcttcgcccgcatcaaagccgtggagtgcgtagagagcaccgggcgccacatctacttcacgctagtgaccgaaggcgggggcgagatcgacttccgctgccccctcgaagaccctggctggaacgctcagatcaccctgggcctggtcaagttcaagaatcaacaggccatccagactgtgcgggcccggcagagtcttgggactgggacccttgtgtcctaaaccatgaggcgtatcattttatcgacatgccccccctctcccatctccgtgcccagaagacatgtcagcttctctgtccactttggttggttgggacctggctacatgtgatgagccagaagctatcaacatgaggaagataaacctatcatcatggaaggagccaaccagccagagacggagagcagaagccagtaggggctgagcatgaagattcagttcctggacactaagactgttgttatatccagctcagacttgcgagccacaggcctggcctccagtatcatgacttgggccttacctggtccagcccttggttctgggttctgcagactgctgtttgacctctggctttgagacatgcccaaagaagggctggctgttcttcatggcgtgctaagccagtgcctcagaactcaggaggccagcctggggtccagaagatgaccaccttaccttaggacagccactggactcagcttgtggaggggggtctgctgggctggagtcctgtgcctggggggggtctcctgctgcttaggtccttttgggacccccccgcccatctgtaccctttctttgcacacttcttccctcacccctgttgccctctcctcacttcggtgttgggcctggagggggtgggggtggggtaagggttggccctttaccatttcatgcttattccagaatgaagaggcccagttcgtgggcagtaacca

SEQ ID NO: 298 - DNA, 904 bp, Mus musculus
tttgagtccagatcttagggttttacccggacctggctgggagcttttgcctgtcccgtcgcgaccatgtcgttctgcagcttcttcggaggcgaggttttccagaatcacttcgagccaggtgtctacgtgtgtgccaagtgcagctatgagctgttctccagtcactcgaagtacgcacactcatccccgtggccagcgttcactgaaaccatccacccagacagtgtgaccaagtgccctgagaaaaaccgaccagaagctttaaaggtgtcctgtggcaagtgtggcaatgggttgggccacgagttcctgaatgatggccccaagcggggacaatcaagattctgaatatttagcagctcactgaagttcgtccctaaaggcaaagaagctgctgcctcccaggggcactaggacatggactgcgaatggcctgccccctgccccctgccccctgtcccctgccaaccgctccagcctcagtcaccgaatgatctgctctggtcaaatccttctatgccagccagggtggtgatgacccgtgacctttgaggaggggagtaggctgataccgggaactcttggatccttgccttctggcagagaaaacaaaactccgtttcataatctgcaaactcatcttgcctcactctagcttggggaagtgacagttgttgccccattagctggccagcgtggcagggaccctcttctcaccactttgtccagcgtgtacctcccaagagaaagccactgtaccttattggtgtgtttggaagctcttgacacctgggagagtggctgaagctgagacccactcccccccttgattgctctctgggatgatcaagtagaagtcaataaacatgcagcctgagccgttaaaaaaaaaaaaaaaaaa

SEQ ID NO: 299 - DNA, 446 bp, Mus musculus
tggatgttcacagttggttttagctccagctcctccaaggacctcagggtgcctgcactcactgcacaggcacaagcattaacataattaaaaataaaacctaggggtggggagatggcactgagtgtacagtctttccccttgcaaagacaaggaatcagtagctcagttctcagcatccgtggtgggtgggtcagggtttcctaactttagcgccctcttctggattctgcaggcaccggcaaacctgaagtggttaaatacagttaataggagtagggctgggtgttttatttttttattttccccctgcctgtgaggtataggggtgggataaggtccccctgtgtagctctgcctttcctggaactcaccaggtagaccagagatccatccatcagcctctccacaaaaactgagattaaaggcacgtgtgtaggtctgac

SEQ ID NO: 300 - DNA, 610 bp, Mus musculus
gtggctgcatgcgacagcgcttggcgcgcggagctacagccatggcagtcgccgtcgagggcgcccgcaggaaagagcgcatcctctgcctgtttgacgtggacgggaccctcacgccagctcgccagaaaattgaccctgaggtatcggccttcctgcagaagctacgaagcagggtacagatcggcgtggtgggtggctctgactactctaagatcgccgagcagctgggagagggggatgaagtcattgagaagtttgactacgtgtttgctgagaatgggacagtgcagtataaacacggacggctactctccaaacagacgatccagaaccacctgggggaggagctcctgcaggacttgatcaacttctgccttagctacatggccctgctcagactgcccaagaagcgtgggaccttcattgagttccggaatggcatgctgaacgtctcgcccattggccgcagctgcaccctggaggagaggatcgagttctcggaactggacaaggtgccgtttgccgggcagctgtagaccctgtcactcggccactctgagcttggctttctcgtcagtaaagtgggttaggaggaggagtatacggc

SEQ ID NO: 301 - DNA, 1079 bp, Mus musculus
ccggcctctgtcgcacgcgaccctggcggtggctgcagcgacagcgcttggcgcgcggagctacagccatggcagtcgccgtcgagggcgcccgcaggaaagagcgcatcctctgcctgtttgacgtggacgggaccctcacgccagctcgccagaaaattgaccctgagacgatccagaaccacctgggggaggagctcctgcaggacttgatcaacttctgccttagctacatggccctgctcagactgcccaagaagcgtgggaccttcattgagttccggaatggcatgctgaacgtctcgcccattggccgcagctgcaccctggaggagaggatcgagttctcggaactggacaagaaggagaagatccgggagaagtttgtggaagccttgaagacagagtttgctggcaaggggctgcggttctcccgaggaggcatgataagcttcgatgtcttccccgagggctgggataagcgctactgcctggacagcctggatgaagacagctttgacatcatccacttctttggaaatgagaccagtcctggcgggaatgactttgagatctatgcggacccccggactgtcggccatagcgtggtctcccctcaggacactgtacagcgatgccgtgagctcttcttcccagagacagcccacgaggcgtgactgggcccacagctgagcactgggaccttcaaagagctctgaccaggcctgaagatagaaccattgggtgccacggttcccatcccactggcccaacacgtagcatcctgtgggggcactgcagggtcacccacacaggaccaacgtctgtgtgggaactgtccccagccaggtggctcctgacgagacgcatacctgctctctaccctgatggtcctggcctctgatgctgctggttttggggacagaacaggtctcaccacagggtggcatgggagttgtgctatggagcctgctggccacagactgacaagggacagaatggcagagaaggggcattacttaaaggactctgtcacagatattaaagttcccaagacaaaaaaaaaaaaaaaaaaaaaa

SEQ ID NO: 302 - DNA, 5115 bp, Mus musculus
gaagtttctaacccagaagctgagcttcgtcaaggcacaattatggaaaaatcaaaaggctccgaaaggaagatattgggagaagagttagaacagcaagccttgggcagtcccagagaggccggcagagtcctggcagggaggagagggttaaatcccttcctctgcagtacaaaagaaaagagtgtgcggaaagattaggatttttgcttttacaataggagctgcaggagcgttgggaagaagctgaaggggaaaaaagggggcgtctctcctttaaagacttgggagattgagagagaaagggagtcgggaaagagtcacactagtcagtccgtctctgggacgggagaattcctctgctcctcagtggtttgcactggggtaccgatacccgttggcctcaggctagacagggtgatcggaccaggtcaccccattaaaactcagtgcgcggtgaggtgccctccctctcttaccgctcactactcgggaatgtctcggcgaaagcaacggagaccccaacagttaatctcggactgtgaaggtcccagcgcatctgagaacggtgatgctagcgaggaagaccacccccaagtctgtgccaaatgctgcgcacaattctctgacccgaccgaattcctcgctcaccagaactcatgttgcactgacccaccggtaatggtgataattggaggccaggagaatcccagcaactcttcagcctcctctgcgccccgaccagagggccacagtaggtcccaggtcatggatacagagcacagcaatcccccagattctgggtcctctggggccccggatcccacttgggggccagagcggaggggagaggaatcttctgggcaattcctggtcgctgccacaggtacagcggctgggggaggtgggggccttatcttggccagtcccaagctgggagcaaccccattacctccagaatccactcctgcaccccctcctcccccacctccccctccccctccaggtgtaggcagtggccacttgaacattcctctgatcttggaagagttgcgggtgctgcagcagcgccagattcaccagatgcagatgactgaacaaatctgccgccaggtgctgctacttggctccttggggcagaccgtgggtgcccctgccagtccctcagagctacctgggacaggggctgcctcttccaccaagcccctactgcctctcttcagtcccatcaagccagcgcaaactggcaagacactggcatcttcctcttcgtcatcctcctcctctggagctgaaccgcctaagcaggctttcttccacctttaccatccactgggatcacagcatcccttctctgtaggaggggttgggcggagccacaaacccacccctgccccttcccctgcgctgccaggcagtacggatcagctgattgcttcacctcatctggcattcccaggcaccaccggactcctggcagctcagtgtcttggggcagcaaggggccttgaggctgctgcctccccagggctcctgaagccaaagaacggaagtggtgaactgggctatggggaagtgatcagttccttggagaaacccggtggaaggcacaaatgccgcttttgtgcaaaagtattcggcagtgacagcgccctgcagatccaccttcgttcccacactggtgagaggccctataagtgcaacgtctgtggtaaccgtttcacaactcggggcaacctcaaagtacattttcaccggcatcgtgagaagtacccacatgtgcaaatgaatccacatccagtaccggagcacctagactacgtcatcaccagcagtgggctgccttacggaatgtctgtgccaccagagaaagcagaagaggaggcaggcacaccaggcggaggtgttgaacgcaaacccctagtggcctccaccacagcactcagtgccacagagagcctgacactgctctccactggcacaagcacagcagtggctcctgggctccctactttcaacaagtttgtgctcatgaaggcagtggaacccaagagtaaagcggatgagaacacgcccccagggagtgagggctccgccatcgctggagtagcagacagtggctcagcaacccgaatgcagctaagtaagctggtgacgtcactaccgagttgggcactgcttactaatcacttgaagtcaactggaagtttccccttcccttatgtgctagaacccttgggggcttcgccttctgagacctcaaagctgcagcagctagtagaaaagattgaccgccaaggagctgtggcggtggcatctactgcctcgggagctcccaccacttctgcccctgcaccttcctcctccgcttctggacctaaccagtgtgtgatctgtcttcgggtcctgagctgccctcgggctctacgcctgcattatggccaacatggaggtgagcggcccttcaagtgtaaagtgtgtggccgagctttctccacaaggggcaatttgcgcgcacatttcgtgggtcacaagaccagtccagctgcccgggctcagaactcctgccccatttgtcagaagaagttcactaatgctgtcactctgcagcaacatgttcggatgcacctggggggccagatccccaatgggggttccgcactttctgaaggtgggggagctgcccaggaaaacagctctgagcagtctacagcctctggaccagggagtttcccccagccgcagtcccagcagccatctccagaagaggagatgtctgaggaagaggaagaggatgaggaagaggaggaagacgtgacagatgaagattccctagcaggaagaggctctgagagtgggggagagaaggccatatcagtacgaggtgactcagaagaggtatctggggcagaggaagaagtggcaacatcagtagcagcacccaccactgtgaaggagatggacagtaatgagaaagcccctcaacacactctgccgccacctccgccaccacccgacaacctggatcatccccaacccatggagcagggaaccagtgatgtttccggagccatggaggaagaagccaaactggagggaacctcaagcccgatggcagccctcacccaagaaggggagggcaccagcacccctttggtggaagagctgaacttaccggaagccatgaagaaggatccaggagagagcagcggcaggaaggcctgtgaagtatgtggccagagctttcctacccagacagctctggaggagcatcagaagacccatcccaaggatgggccactcttcacttgtgtcttctgcaggcagggcttccttgaccgtgctaccctcaagaagcacatgctgttggctcaccaccaggtaccgccctttgcaccccatggccctcagaatattgctactctttccttggtccctggctgttcctcctccatcccttctccagggctctccccattccctcgaaaagatgaccccaccatgccatgagcctgctttctgtacctggtcctctatgactcagagagcagaaacctgagagcttcatagaggaacctccaagatttactcaccctcctcttgtcctttctcaagtcctgacatgatgtttctagtggcttcttctctagtccctgagcttgacaattgcctttgaaagagaatgtccccttaagaaatttttatcacctttttgttctgtgtaactaagggaaacaaattccctatagcttttacattctcaagggggagctctctcctcttctccctttccctttggcaggtatactagaacccccatccttggagtggcagccttggtccaaggggctggcaactgtccatggaaggcccagcgttactccttggtgatcttgaccaccctgcaagactttctagggccgggaccttcttgagaagcttgtaaggggtggtaggtttctttctgcaaccactacccagttttccactgagccctggagttctggacctacctgcattgccactcgggccctagtaccatcattgctgtgaaagcccaggaactgtgtttcacaaggtgactccagtgacatgatccagagaggcagagaacatagcctccggaagttgaggctgtgcccaacaagcacaccggaagaaagaagaaactataacttctttctccttcccccctgctccagagagtgctggcaataaagatattctagcaattggtgactcaccctagaaggtagggacaagtgaaggactgggatcctttttgcagtatgttccttgactcgccacatggaggcaaagatagtggctggtcaagatgccaggactactccagcttcccatcatgtccgctcaaccaacaagcaggtttcctaccaagaggtctctcgtgtgatagtttagggagtatgaagtttctaactctaaagaatcctgttggtgaggatgattatttaagcaatgatggggagttgagggttgttgctaaaacaggcattgctgggaatctatttgatgaagaacaggacttgatgtaaggggactcgatgttcagctcttgtgagtatgaacgttttctttgagctaatggtgatgtggtatgcagaggtaccaggggccatgggggtgtgtgtgcttcctgtcactagaatgtttttagttttagatgactccctattttattccctcaccccttgtatttcccttgctgtcttctcaaaacccctttcctcccccagttttgcctgaccatgggccagagcttatgtcttattttttttctagaagttgagagacagagcttcaagtggtttccccccgtctctgtcttgtagtgagatgtagtatttactcttaacataggatcctgtggaacaggtgttctgagaagactgaattttgctgttagctgttgtcaatgatgattctctaaagtagtgggctccagagctccctaacacagtgaaatgtgtaagagccgagaggggagatactagaattttttccttcatcattaaaggtgttttggccaaaaaaaaaaaaaaaaaaaaaaaaaaaaaaaaaaaaaaaaaaaaaaaaaaaaaaaaaaaaaaaaaa

SEQ ID NO: 303 - DNA, 1421 bp, Mus musculus
gacggacacactcagcagccagaggccaccggcagacagatcgcagctctgtagacaatatgctgttcttggggcagaaggccttgctgcttgtcttggcaatcagcatcccctctgactggctacccctaggggtcagtggtcaacgcggagatgatgtgcctgagacattcacagacgaccctaatctggtgaacgatccctctacagacgatacagctctggctgatatcacaccttccacagatgacctagctggtgacaaaaatgctactgcagagtgccgggatgagaagtttgcttgtacaagactgtactctgtccatcggccagtcagacagtgtgtgcaccagtcctgcttcaccagtttacggcgcatgtacatcatcaataatgagatctgttcccgactcgtctgtaaagaacatgaagctatgaaagatgagctttgccggcagatggcaggcctgcctccaaggcgacttcggcgctccaactacttccgacttcctccctgtgaaaatatgaatttgcagagacccgatggtctgtgatcaccaaggaagaaagaagaaaatgtggatgaaggaatcgaaaattctttctcctccaacccctgccatctgtcccgtagacatgtatttttaaactaagccctttgcaatgccccggcttcctaccctactctaattttcactggtgctggtaacgtttgtctcattttgcggtactgacaatacattgtctatattgtggcacgggtttgctgatttctggtgttgtagacaagatggataaaggatggccacttgacttagatacattcagctacattcagctcctgcagtagaaaggggctggggtgcgtggctcagttggcagaaaacttacctaacctttaggttaatattttttttaaatggtgctatgaattgatctcagagcctcgtatataatagtcaatgctctatcactaagctatacccctatctcctaagtagataattttaattattaaatatgccagagccaggagcttgccagaggctcgagccacagagcttccttctagaagtttcctaggttaactcctcattgtttacatatcctctgtactcacctttcaccatgcttcgtggcttgtcctaaattttgcccagcaagtcttcatgatgggaaggttgtgggtgaggcaagagagatggctcaatggtagacactgatgtcttccagaggacctgggttcagttcccagccagcatcacatggtggctcacaatcacccataagtctagttccagaggacctgagatattttctggcatccatgggcactgcatgcatatgtcacacagacatacatgtggaaaacacacataaaaataaatcactttttaaaaggcaaaaaaaaaaaaaaaaaa

SEQ ID NO: 304 - DNA, 331 bp, Mus musculus
gattgcttcttctacactcggtttcttccccaaacgcgattgagttgagggttgaaactcgtcacaacctcttatcaaccattttttattcaagttttttaccattaccaattacacttgcttcgccttattttgatcagcatagtagtagattaactttgttttccctcagcttcccgaagcccttgctttatacgtgtgtttcgtcactgaagattgaccttgtatgaatactgaggtttcttggtaatgctttgtacaatccaaaatgttaaattggctatctgttgaaagtgtatgcttctaataaaaagcgtttagttttcatccc

SEQ ID NO: 305 - DNA, 1563 bp, Mus musculus
atcggcgtactgccactagttcctgacttccagagactcatcatgtctgaggctgctcctgctgcccctgctgccgcgccccctgcggagaaggcgcctgccaaaaagaaggccgccaagaagcccgccggggtgcgccgtaaggcgtccggacccccggtgtccgagctcatcaccaaggctgtggccgcctccaaggagcgcagcggcgtgtccctggctgcgctcaagaaggcgctggcggccgcggggtacgatgtggagaagaacaacagccgcatcaagctcggcctgaagagcctggtgagcaagggcatcctggtgcaaaccaagggcaccggcgcctccggctccttcaaactcaacaagaaggcggcttctggcgaggccaaaccccaggctaagaaggcaggcgcggccaaggcgaagaagcccgcgggagcagccaagaagcctaagaaggcgactggtgctgccacacccaaaaaggcggccaagaagaccccgaagaaggcgaagaagcccgcggcggcggctgtgaccaagaaagtggccaagagcccaaagaaggcgaaggtcaccaagcccaagaaggtcaagagcgcgtctaaagccgtaaagccaaaggctgccaagcccaaggttgccaaggccaagaaggttgcagccaagaaaaagtaggctgcctcccctaacaatccaaaaggctcttttcagagccaccactcccacttaagagctgtgacatttgtgtgattaatgaagcaaggttgcaagggactcgatcccggcagcactcgctcccccggtgggatgggtggggttgcgtgtcccacctagacttgtttgtgctgggctgctcaggaagtgctatgggctggaacaccctcccacggctgtcagcagcagaaagcaaccctcggcgctagttcgtattggactgcaaggtgatttgaaagttccgccctgcttgtgggttggctcactccggcccaggactctagttcttcgtttgattgggcgccatcccgaagtttgagcttcctgcctggagaaacgcatccggggcttgtaggtggcttctatgctcagcctcttttgtgggggttagcctggaagtttgggagaaggtagggtgctggcgccaacgaactgccttccttaatattaaaggcatggggtagctgccggaacgactagcttgcacagttaagttggactcgggactgagacgattgcttctcgtactttcggtttgtttgccacagcgatggagttgtgggttgaactgcgtcacaaccttttgtcagccatttttttttttcaagttttttaccattaccaattacacttgctttgccttattttgatcagcatagttgtagattaactttgttttgcctcagcttcccgaagcgcttgctttatacgtgtgtttcgtcactgaagattgaccttgtatgaatactgaggtttcttggtaatgctttgtacaatccaaaatgttaaattggctatctgttgaaagtgtatgcttctaataaaagcgtttagttttcattc

SEQ ID NO: 306 - DNA, 695 bp, Mus musculus
  modified_base (75)..(75): a, c, g, t, unknown or other
gtactttttgacaagtaatggtgtgtgtgtcaatttgaaccctaaaagaagcatcgtagatgaaggaaaccttgncggtcatgtatcgtggctagggtgggcacgatcagagggtcacgtgcccgagaaagctccagcaaagcgtgagaacttgcctcagtgtggggggaagggctgagatacagaagccaccttgccccagaagaatttcagcggcggctgtatgagaaattctgtttccttatttcacacctgggaagactcagcagccagcagctgaggggccatccactaagcacaagaggaattcgttctacccaaggagccccgtgcctctcaaatgcgctccgagtttgttatggtttctattcttacaactaacggtatcaaaaccacttcctgggattgtacaagtgctgccagaataaatgtttcccccttctaaggaaaaaaaaacaaaacaaaacaagacaaaaaatccgacagtgctcatgtttgacgtgtgcgctggactcttttgaatgaataaagaggaagggcttgttgggattccagtggagtgtgtgtttttcatgctgcagtctgtgaattgtaattgtggtttcccagttcattgtcctaacggggcagaagttaaaaaacaaaacaaaaacaaaacaaaacaaaaaaaacaataaaaacacaatgaaatgggt

SEQ ID NO: 307 - DNA, 1942 bp, Mus musculus
acagactggtccaggcctcccgcagctggttccgaggtgctagcccctccgtgtttgcgcatggaggggcgcgtgagctccgtgggctcgccccacagtttcctcaacgctcccgtgcttttccgcggccccgtggagcccctagtcttcctggccaactttgccctggttctgcagggaccgctcaccacacagtacctttggcaccggttcagcacggagctcggctacaatggcacccgccaccgggagaactgtgggaaccaaagcgcggatcccctcatgaaggaagtggagaccctgacatctcactggaccctctacatgaacgtgggaggcttcctggtgggactcttctggtccaccctgctgggagcctggagtgaccgcgtgggtcgccgcccattgctggtgctggcctctcttggtctgctgctccaggccgtggtgtccatctttgtggtgcagctagaactgcacgtcgggttcttcgtgcttggccgagctctttgtgcccttctgggagacttcaacggcctccttgctgctagctttgcctctgtggcagatgttagctctaaccacagtcgcaccttccggatggctctgctggaagcatgcattggtgtggccgggaccctggcaagccttctcgggggtcactggctccgggcccagggttatgccaaccccttctggctggctttggccctgctgattgtcatggctctatacgcagcattttgttttggtgagacggtgaaggagccaaagtccaccaggcttttcacgctccgccatcatcgatccattgcccggctatatgtggttccagccccagaaaagtccaggatgcatctagccctgtactctttggccatattcgtggtggttactgtgcattttggggctcaagatatcctgacactctatgagctgagcgcacccctctgctgggactccaagctgattggctatggctcagcagcccagcacctaccctacctcaccagcctgctgggcctaaggcttctgcaattctgcctggctgacacctgggtggctgagattggcctggctttcaacatcctgggaatggtggtctttgcgtttgctaccattacacccctcatgttcacagggtacggattgctcttcctgtcattggtcacgacgcctgtcatccgggccaagctttccaagctggtgagcgagtcggagcagggtgctctgttctctgctgtggcctgtgtgaatagcttggtcatgttgatggcctccggcatcttcaactccatctacccggccactctgaacttcatgaagggcttccccttcctcctgggagctggcctcctcttcattccagccattctgattggggtactggaaaaggttaatccacacccggagttccagcagtttcctcagagcccctgatctgcccgaagccatgaggagcaatggacccacactgacgatgtatgcctaaagcccagcacaccagccacctcggaatccgtccttgaccacagtctatccacccttgacctcagccttggcagtactcactctggagagggagttcaagccagttatgagcaacacctactctctgactgagccaatctctgctagatacagaatctaatcaggagaggtccactttagggcaggctgcaaggagccatttgtggcaagggtttcttccccccccccccatgctattcatcactcagaaccttctagagtgaaggagatggcatttcagggaccaagcgtgagaccgacctctccttctagcccatggtactaggtctctgctgtgttcagtggcttccaggcgatgaagctctgtctatggttgggaagccgtccttgaccacagtctacccacccttgacctcagccttggcaattgtcacagtaaattgtttgaatc

SEQ ID NO: 308 - DNA, 580 bp, Mus musculus
  modified_base (101)..(101): a, c, g, t, unknown or other
  modified_base (377)..(377): a, c, g, t, unknown or other
  modified_base (416)..(416): a, c, g, t, unknown or other
  modified_base (452)..(452): a, c, g, t, unknown or other
  modified_base (478)..(478): a, c, g, t, unknown or other
  modified_base (554)..(554): a, c, g, t, unknown or other
cagtgatatagcaaaacttttattcacaagaaaactcgaaaacaaaatcacaacccaggccaataatttctatctggtccctgccctcatcctccctccangctcctccatatcctccatttgagtgggtcgtggtgcatgcagggagtggaactgacggatcctgtgtcccttgggcagaaaagagtcctttcaggcccagtctctcccatcctctatacatcatggaggatggattctggcacatttccaggattccccctccaaattcattgaggaatcatgcctgcgccaatagcactgcacttttggggttacagctcatcttcatccagcttggcgagcctggcctgacatggaggagtgttcacagtggnaaggggctggagagtctgaggagtctggggggtatcacngagagccgtgtatccagggggaacagcactctgganacctcccctctgggcagaagtagcanggaagggagagagccattgatgggtgtgtgcatgctgggctggggccaggtttccagggcgcattcttccaggggntcccaacccaagggccctcctggttc

SEQ ID NO: 309 - DNA, 3263 bp, Mus musculus; identical to SEQ ID NO: 54

SEQ ID NO: 310 - DNA, 2911 bp, Mus musculus
gagtgtctccccgcccccgcaggaggggcggggaggggtgaatggagtagcggagatccctcagccccagcgctcccctctctggcctccgcacccgcctgcctgcagcgccactcgcactgttccccctccttaccccgagaggggacccatgagtccgaacccctccccgccaggcctccacgtcgccgacccgcaatggccaagcgcagttcgctgtccatccgaatcgtagaagggaaaaatctgcccgccaaggacatcacgggcagcagcgacccctactgcatcgtgaaggtggacaatgaacccatcatcaggacagccactgtgtggaagaccctgtgccccttctggggtgaagactaccaagtacacttgccccccacgttccacacggtggccttctatgtcatggatgaggatgcccttagccgggacgatgtgatcgggaaggtctgcctcacgagggacgcgctagcctctcacccaaagggattcagtggatggacccacctggtggaggtggacccgaacgaggaggtgcagggtgagatccacctgcgcctggaggtggtgccaggggtccatgccagccggctgcgctgcgcggtgcttgaggcgagggacttagcaccaaaagatcggaatggcgcatctgacccttttgtccgagtgcactacaatggccggacccaggagacctcggtggtgaagaaatcctgctacccacgctggaatgagacatttgattttgagctggaaaaaggagcctcagaagcactgctggtggaggcctgggactgggatcttgttagccggaatgactttctaggcaaagtggcggtcaatgtccagagactttgttcagcccagcaggaagagggctggttccggctgcagcctgaccagtccaaaagccgtcaaggcaagggcaacctgggctccttgcagttggaagtgcggctgcgggacgagacagtgctgccgtccgtctgctaccagcccctggtacaactgttgtgccaggaggtgaagctgggcactcagggcccaggacggctgattcctgtcattgaggagacaactagtgccgagtgtcgccaggaagtggccaccaccctgctcaaactcttcctggggcaggggctggccaaggactttctggatctgctttttcagctggagctgggccgcaccagtgaagccaacaccctcttccggagcaattctctggcctcaaagtccatggagtctttcctgaaggtggcagggatgcgctatctgcatggcatcctgggccccatcattgacagagtgttcgaggagaagaagtacgtggagctggaccccagcaaagtggaagttaaggatgtagggtgctctgggctgcaccgcccacagaccgaagctgaagtgttagagcagagtgcacagacgctgcgtgcccacttagtggcgctgctgagcgccatatgccgctcggttcgcacgtgcccagccatcatccgcgccacattccggcagctgttcaggcgcgtgcgcgagcgcttcccgaacgcccagcaccagaacgtaccattcatcgcggtcaccagcttcctgtgcctgcgcttcttctctcccgccatcctgtcgcccaagctcttccacctgcgagagcggcatgcagatgcccgcaccagccgcacgctgcttctgctggccaaggcggtccagaacataggcaatatggacacaccggtctctagggccaaagagtcgtggatggaaccactccagcctaccgtgcgccagggcgtggcgcagctgaaggacttcattatgaagcttgtggacatagaagaaaaggaagagctggacctgcagcgggctttgaactcacaggcaccacctgtgaaggagggaccattgttcatccacaggaccaaaggcaaaggccctcttgcatcctcctcgttcaagaaactctacttctcccttaccactgaagccctcagcttcgccaagacgtccagctccaagaaaagcaccttcatcaagctggccagcatccgggctgcggagaaggtggaggaaaagagcttcggcagctcccacatcatgcaggtcatctatgcagatgatgttggccgtgcccagactgtctacctgcagtgcaagtgtgtgaacgagttgaaccagtggctgtctgcattgcgcaaagcgagcaccaacaacaggggcctcctacggtcataccatcctggcatcttccgtggggacaagtggagctgctgtcaccagaaggacaagacagatcagggatgtgacaagacccactctcgggtgaccctgcaggaatggaatgacccactggatcatgaccttgaggctcagctcatctacaggcacctgctaggcgtggaggctgctctgcgggaaagataccagctcctgcgtggggcgacagaagcaggtgtctcacccacgggctgtgatggagctcccgaggactcgctggcccagctgcttcgtgtgctgcaagaccttcgagaagcccacggctccagcctggccagcccagcagccagagagccccatcaccttctagagctacagacgtgaggtgtccgtgaggtgtccatcgagcccctgttaggtgtttgcagatcctagacatgctcaggatccttgtcccagtcaactgttctggggagggctgtgacccagcatagtcttctccatgtctgcgagggacaaccgtgacacctgcttccttgggagaaccaactgctcttgtagtccccatgacccatattcttcacccaggagaacaggctgtccacctcacattgctttgccactgtctggcctcctaggtcggatgccacagtggtttgctgtcataaataaatgctctgtaactgcc

SEQ ID NO: 311 - DNA, 3512 bp, Mus musculus
ggcgcccaggggaaaggaagctgggggccgcctggcggcattcctcgccgcagtgtgggctccgtctgccgcggggcccgcagtgccccctgtctgcgccagcacctgttggcccgccagctggccgcccgcgccccccgcgccccccgcgcccgcccggccgccagccccgcgccccgcgcgccgcccgctgggggaaagtggagacggggaggggacaagagcgatcctccaggccagccaggccttcccttagccgcccgtgcttagccgccacctctcctcagccctgcgtcctgccctgccttagggcaggcatccgagcgctcgcgactccgagccgcccaagctctcccggcttcccgcagcacttcgccggtacccgagggaacttcggtggccaccgactgcagcaaggaggaggctccgcggtggatccgggccagtcccgagtcgtccccgcggcctctctgcccgcccgggacccgcgcggcactcgcagggcacggtcccctccccccaggtgggggtggggcgccgcctgccgccccgatcagcagctttgtcattgatcccaaggtgctcgcctcgctgccgacctggcttccagtctggcttggcgggaccccgagtcctcgcctgtgtcctgtcccccaaactgacaggtgctccctgcgagtcgccacgactcatcgccgctcccccgcgtccccaccccttctttcctccctcgcctacccccaccccccgcacttcggcacagctcaggatttgtttaaaccttgggaaactggttcaggtccaggttttgctttgatccttttcaaaaactggagacacagaagagggctctaggaaaaacttttggatgggattatgtggaaactaccctgcgattctctgctgccagagccggccaggcgcttccaccgcagcgcagcctttccccggctgggctgagccttggagtcgtcgcttccccagtgcccgccgcgagtgagccctcgccccagtcagccaaatgctcctcctcggcctcctcctgctgacatctgccctggccggccaaagaacggggactcgggctgagtccaacctgagcagcaagttgcagctctccagcgacaaggaacagaacggagtgcaagatccccggcatgagagagttgtcactatatctggtaatgggagcatccacagcccgaagtttcctcatacatacccaagaaatatggtgctggtgtggagattagttgcagtagatgaaaatgtgcggatccagctgacatttgatgagagatttgggctggaagatccagaagacgatatatgcaagtatgattttgtagaagttgaggagcccagtgatggaagtgttttaggacgctggtgtggttctgggactgtgccaggaaagcagacttctaaaggaaatcatatcaggataagatttgtatctgatgagtattttccatctgaacccggattctgcatccactacagtattatcatgccacaagtcacagaaaccacgagtccttcggtgttgcccccttcatctttgtcattggacctgctcaacaatgctgtgactgccttcagtaccttggaagagctgattcggtacctagagccagatcgatggcaggtggacttggacagcctctacaagccaacatggcagcttttgggcaaggctttcctgtatgggaaaaaaagcaaagtggtgaatctgaatctcctcaaggaagaggtaaaactctacagctgcacaccccggaacttctcagtgtccatacgggaagagctaaagaggacagataccatattctggccaggttgtctcctggtcaagcgctgtggaggaaattgtgcctgttgtctccataattgcaatgaatgtcagtgtgtcccacgtaaagttacaaaaaagtaccatgaggtccttcagttgagaccaaaaactggagtcaagggattgcataagtcactcactgatgtggctctggaacaccacgaggaatgtgactgtgtgtgtagaggaaacgcaggagggtaactgcagccttcgtagcagcacacgtgagcactggcattctgtgtacccccacaagcaaccttcatccccaccagcgttggccgcagggctctcagctgctgatgctggctatggtaaagatcttactcgtctccaaccaaattctcagttgtttgcttcaatagccttcccctgcaggacttcaagtgtcttctaaaagaccagaggcaccaagaggagtcaatcacaaagcactgccttctagaggaagcccagacaatggtcttctgaccacagaaacaaatgaaatgaatgtagatcgctagcaaactctggagtgacagcatttcttttccactgacagaatggtgtagcttagttgtcttgatatgggcaagtgatgtcagcacaagaaaatggtgaaaaacacacacttgattgtgaacaatgcagaaatacttggatttctccaacctgtttgcatagatagacagatgctctgttttctacaaactcaaagcttttagagagcagctatgttaataggaattaaatgtgccatgctgaaaggaaagactgaagttttcaatgcttggcaacttctccgcaatttggaggaaaggtgcggtcatggtttggagaaagcacacctgcacagaggagtggccttcccttcccttccctctgaggtggcttctgtgtttcattgtgtatatttttatattctccttttgacattataactgttggcttttctaatcttgttaaatatttctatttttaccaaaggtatttaatattcttttttatgacaacctagagcaattatttttagcttgataatttttttttctaaacaaaattgttatagccagaagaacaaagatgattgatataaaaatcttgttgctctgacaaaaacatatgtatttcttccttgtatggtgctagagcttagcgtcatctgcatttgaaaagatggaatggggaagtttttagaattggtaggtcgcagggacagtttgataacaactgtactatcatcaattcccaattctgttcttagagctacgaacagaacagagcttgagtaaatatggagccattgctaacctacccctttctatgggaaataggagtatagctcagagaagcacgtccccagaaacctcgaccatttctaggcacagtgttctgggctatgctgcgctgtatggacatatcctatttatttcaatactagggttttattacctttaaactctgctccatacacttgtattaatacatggatatttttatgtacagaagtatatcatttaaggagttcacttattatactctttggcaattgcaaagaaaatcaacataatacattgcttgtaaatgcttaatctgtgcccaagttttgtggtgactatttgaattaaaatgtattgaatcatcaaataaaataatctggctattttgggga

SEQ ID NO: 312 - DNA, 621 bp, Mus musculus
ctgcgagatggaggaggtggatctgcaggacctgccgagcgccaccatcgcctgccacctggacccgcgcgtgttcgtggacggcctgtgccgggccaaatttgaatccctcttcagaacatatgacaaggacaccaccttccagtattttaagagcttcaaacgtgtccggataaacttcagcaaccccttatctgcagccgatgccaggctgcggctgcacaagaccgagttcctggggaaggaaatgaagttgtattttgctcagactttacacataggaagttcacacctggctccgcccaatcccgacaaacagttcctcatctcccctccggcctctcctcccgttggctggaaacaagtagaagatgccacccccgtcataaattacgatcttttatatgccatctccaagctggggccaggagagaagtatgaactgcatgcagcgacagacaccactcccagtgtggtggtccacgtgtgtgagagtgaccaagagaatgaggaggaagaggaagagatggagagaatgaagagacccaagcccaaaatcatccagacacggagaccggagtacacacccatccacctcagctgaaccggcgcgcagactga

SEQ ID NO: 313 - DNA, 621 bp, Mus musculus; identical to SEQ ID NO: 312

SEQ ID NO: 314 - DNA, 517 bp, Mus musculus
gacagtacaccaggagcaactaactccaaagttctttatttaattcggttggagcatcgatgggatggcaaccaaactcacacgcgcgcaactgtgttacaaacgaggagcagcttcagtgaccgcagaatatgcccgcctcccctggtctcatagccaaagtagcaaatctgaacttcctttcaggtcaggattgctgtggcctgtgtgtccctgcccaggaccctaatgctcagtctcaagattggccacttctgccctagatcctcagaatgcccaaaaggcagggagaggtgaacacgagggagccctggcagctctccaaaagtctcctgtctttctttagtgcaccccctggccccccagccaccatccagagctctagggtccacgaaaaaatagtgctagggacctgcagggcctggccattagggttgtcattcaagtcatctgttggagagtggggagggcatacctggggggcatcctgagctgtctccaccttatctgataccca

SEQ ID NO: 315 - DNA, 2699 bp, Mus musculus
ggccccgccggggaaaccagatgaagcacatctggacagctgtgctgagaaagtttgtgggcctcttccaggcctgccacccgcaaggcacgtcccccacgtagcctcctgctagccacttactacttaatttttttttccccaagaagcaataagcaacccacgcttgaatctttttctctccctcccccccaccccccatgtgaggcgaggccacatcacattcaacacagtttagttttcatggggctttgagatcaaaagaacagaaacagcaaccaaagctcagctgccttctgatcctaactgacaaagtggggagagtaaggtgtgcgcaaacaggacaagttgggtcatggggagtttcaaaggacatgctctccctgggagtttcttcttcgccatgggcttttggtggactatgaagaacatcctgaaatctgtctacaaaaggcaaactcgaacctgctaccttaactctaaaacattattacgtcggacagagatttgggaaggagttgttgtgcttttaatgtctctcactggtatagctggtgaacagtttatctcaggaggacctgccttgatcttgcataaagatggccagtggaaccagatcctgggctggcatcacacaaccatgtacttattctttgggctacagggtataacccaaatcatatgtttcactactaatgtacttccactttcctcaagcaagttaatgttatcaattgccatctttgtggagacatttatgttctacaaccacacacacggtcgggaaatgattgacatttttgtacaccaacttctggtcttcgttggcacattttcgggtctggttgccttcttggagttcctcgtaaagaacaacgcacttctggagctcctgcggtgcagtctcctcatgtttcaaggaacctggttctggcagatggcgtttgtgctgtacccccctagtggaagtgctacatggaacctgtcagatattcaaaataaaatgtttctctcaatgtgcttttgctggcattatgcatcaatccttatcctcattggagtaaaatatgctttggccaactggttagtcaagtctaggctgaggaagggctgcacctcagaagttggactcctgaagcatgctgaccgtgagcaagaatcagaagaagaagtatgatcttgaagtctttcttgataagccttctccctttgcgttgcctttgttcatggctttgtttcttgacctctggtctcaagaacacttgtctgaggctgactccatgctgtttgtacttccagttttgttaaagtgttggactttaagtatcttactttcagctctgaaagaaccatgagtgataaattcactttttacactgtgcatgccatgtaattcaagaccaatcataattgttttccaaagtttagtttcgtgtccatttattaaaaatattttttttattttccgggtagataccttcaagatttgtggacttgccatcactgtaatacatgacgtgttgacttgtatttgtctatcttgttgccacaatggaaaataaatgaatgcatgcaccttggtgcagaaaccaaaaatcctcattttttttttcttagtaaagtataccgcaccctcacatgatacagaaaaaaatctgcatgtacaaaattccatttctttgagacttttctctatggagagcttgatgcaaaaggtagagcagaagtcttcttctgcattttcaaaaagtaatgatgttgagacatatagtttcaaagatgacagagactaggagagaggaattgtggtattcacataacctagcgttggtcactgtgccatttgctctgttaatgaggtaaaggattaaataacaagcctttctacaatcctaggtaaaaagtctttttgccctgtgggccaagaaactcccagatgtgtgtaaaaaaaaaattatgcatattactctggccctactgttaaccactctccatgtttctcataattagctcatctttcttcttgtacttgatcttagttaaaaggccaaaaggtggttcttcactctaaattaaaggggttaaaatgacttaataggcatatggaccctttcttactatcacatcctatgaatctcaaatggaaacaagaagagaactaaattaatacaatgttacacatcatggtggacctgaagaatgagatgaatataatcttcttgcccaaaaactgggagcagtcatcttgctacataagattttaaaaagacagatgtgagtacccaaaaatatctcttgagctgtaagtgagtgtactccaggatacaaggtaccgatatgtcatggtcctctgacgatcatgtgttctgctcatgtctgtcttagatttaaggactctattttagaccaacaacattctgtgactgccacatttgagcttcaaaggaaccaggaatcagcctcagctagttgagacaagtcactgatattgatgacagataaggttacacccggaagtttgaaagccaatgaatccagattttctgctgtttttatgagaatacagagatcactacttctccaggttcaaacccagagaatacaagtaaacttcaacccagggagttctcagaacatctgagtctgagaccagttcaggaatgcttccctacagtgtctgaaataaaaacctttcttgc

SEQ ID NO: 316 - DNA, 696 bp, Mus musculus
ctaaattgaatcatctagtcctttcctgctacatgtacgtctatgtcaccactacagaggtcgcactggagcaagacctggcatatctgcaagaattaaaggagaaggtggagaacggaagtgaaacagggcccctgcctccagaacttcagcctcttttggaaggggaagtaaaagggggccctgagccaacacctctggtccaaacttttctcagacgacagaggaagctccaagaaattgaacgcaggcgaaatagccctttccatgagcgatttctccgcttcgtgctgcgaaagctctacgtctttcgacgcagcttcctgatgactcgaatttcactccgaaacctgctattaggccgcccttccctagagcaactagcccaagaggtgacatatgcaaacttgcgaccatttgaaccagttgatgagtcaagtgcttcaaacacagattcttcaaatcacccgtcagagccagattctgagcatgttcactctgagttctgagggatgtacagatgctctgtgcagatgtgggggcagcctgttataggcttattgtctacgcaaagaacatatttttggagaaaaatgatatgggacaggctttcacagtacagcccaggctggcctcaaactcatggttggtccctctgcttcagcctgttttgtaattacatagatcaccaaacct

SEQ ID NO: 317 - DNA, 3341 bp, Mus musculus
ggatgcgggcggcagagcgcgagaggcggcggctgggctgcggggcgctgtgactgtccctccacccagtctggtcgcgctcttctcttcggccgattggccgcctcctctccgcaccctggtttctgtctcctgctcctcctttgccccgaccctgttccttatggcagcagctccttgcatcgggggcgcagcttctcagcggactatcctctcactccgcaggctgagcccggtcactggatgttgctgaaactccggagatcatgctctcctttggtcgcagtatcaccgccggctgtccctgccgccgccccctcctctgctgccgcggtccgcgggatgctcagtagcccgctgcgtggcccctgcgatcccgtgttcttcagaagcctttggttgctgcagagttgcgcgaagtagtcatggtgctgtgggagtccccgcggcagtgcagcagctggacactttgcgagggcttctgctggctgctgctgctgcccgtgacgctgcttatcatagcccgcccggtaaaactcgctgctttccctacctccttaagtgactgccaaacgcccaccggctggaactgctccggttacgatgacagagaaaatgatctcttcctgtgtgacaccaacacctgtaaatttgacggggaatgtttaaggattggagacactgtgacttgcgtctgtcagttcaagtgtaacagtgactacgtgcctgtgtgtggctccaatggagagagctaccagaatgagtgctacctgaggcaagctgcctgcaaacagcagagtgagatacttgtggtctcagaaggatcctgtgctacagatacaggatcgggatctggagatggagtccatgaaggctctggcgagaccagtcagaaggagacatccacctgtgacatttgccagtttggggcagagtgtgatgaagatgctgaggatgtctggtgtgtgtgcaacatagactgttctcaaaccaacttcaatcccctctgtgcttctgatgggaaatcttatgataatgcatgtcaaatcaaagaagcgtcatgtcagaaacaggagaaaattgaagtcatgtctctgggtcgatgtcaagataacacaactacaaccactaaatctgaagatgggcattatgcaagaacagattatgcagagaatgctaacaaattagaagaaagtgccagagaacaccacataccttgcccagaacattataatggtttctgcatgcatgggaagtgtgaacactccatcaatatgcaggagccatcttgcagatgcgatgctggttacactggtcaacactgtgaaaagaaggactacagtgttctctacgttgttcctggccctgtccggttccagtacgtcttgattgcagctgtgattggaacaattcagattgctgtcatctgcgtggtggtcctctgcatcacaaggaaatgccccagaagcaacagaattcacagacagaagcaaaatacagggcactacagttcagacaacacaacaagagcatccacacggttaatctagagggagcatgtttcccagtggccggacaaccaacagcttggactacacaatacagtattagagacaaaagaataagacaagatctacacatgttgccttgcgtttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaacaaatggcattcctaaacttgcagtaattcatagctgtaagcacggtccaactgtcatgggctacgcagacagcagtatttcatccctctgtgcatcttcagacaacacattagtttgcacaggaatctgtagctagattttgagtgattccaagatcaagggatataccggttattggaaaagagaaaaaataatttagtttattgaggaagcataagatatgtcatatccttgaatcatctctgcttcatctactttcttccctgtctttcattgtcattcccagaacagaaaaatctctggcatataagttacaaaagggaagaatggaagtgttttgtggctcaaaataaaatgcaaaaaaaagatatttgtctttactgagaagcaacataactatcttagttaaataatctaccagggggcggggtctgagaaaggtatccactaggtgtataaacagtggtcaaacctattctgtttctgtttctgcaagcagaaaaaaaaaagctaagagtacattgtaactgtgtcagtaagtatgagcccaaactgtggcttcttagaagacccttgctgtatttgtatcttatttgaaaagaatttagactaccaaacaaatgcccccacgaacagttttatagcccaaagagtactgttatttgaaactgaaaaacaaaaagacaatgttttatggtaatggagagagataagttttaaacgtatttacataagaaagaaaatccctaagaatctagaggacctccatgagagctgctttcaacccctatgagatacgagcagacaggtatgaatggtcacattgcttggggaaagtaagttgagaacattctcaaggaataagatgaaatacccaattaaataatctccttattatcatttacctctgagtagtttctgtggcacatgtggatgatttaaataaagctttatttgtcttcctcaaatgacttcttcatggactaaaagaaatggcatcccctcctttgttagaaaccaaaaaacacatagcaatccaaaatgttctgaatataaaatattatatgaaaaataagggtctgaggtgaaatttaaactacctgttaatatataataaaggtgacaatctacataagacttaggactttgaaaactgtgtttttctaaattaagtcataaatttgaaaatttgatataaccatcatgcaagtgttgctatgaatcactctcttgatagatagatatgacaaatccctgctaatctgtgtgtgtaatttgtttaacatgcacagagatgtaagtggccctagtattctttatatgttaataactatagcaaataaatcctttcttcttccaaaagaagaagggaaaatgtactattcctagtgaggcataggtttaaagtaacaatttcactgacctttgctttcaaaaatatgaactgactgattttgttccatgtttacttatcactctatataaatttttattcaagatct

SEQ ID NO: 318 - DNA, 1676 bp, Mus musculus
cgggaactgggagattgtagaagaaaagcttcctgcgtagactgtgaagcgaggtggggagtggaaaccgagtgtgcgctggaggtctaagccgactcgcttatgctggctgagcatggaggatctgaaagaggatatcaagttcattgtggacgagaccttggacttcggagggctgtctccatctgacagtcatgaggaagaagacataacagtattagtgagtccagagaaaccacttcgacggggcctcgcccatcggagtaacccaaatgaagtagctcccgccctccagggtgtgcggtttagcttgggcccgctcagcccagagaagctggaagagattcttgatgaagccaaccgcctggcggctcagctggaggagtgtgccctgaaagatcgggagagggctggtacaggccctggaaggcccagccccagagggaaacccagtcctcggcgggagaccttcgtcctgaaggatagccctgtccgagatctgctgcccaccgtgagttcttggagcaccccacctccaagcagcctagctgggctccggagcagtgataaaaaggggtcagccagggctgtccgggtggcatccggaaagaagccctccagcataaagaaggaatcacccacttgcaatctgttccctgcatccaaaagcccggggcgctctcctcttgcacaaccaattcttccacctcggcggaaaactgggttcggtgcccggacaacagcaagcccaccaattcctgtcagaccagttccacagtcctcagctagcaactcccaatgttcatcccggctccagggagcagctgtcaagtcttccagtcgactccctgtcccttcagccatccccaagcctgccacccgagtgccactcattgggcggagtctaccacctggaaaaggtgccctagctccagattctctctcaactcagaaagggcatccaagcgccatagggcacagagcctctgtttcccagaaaacaaaccttccaaccaccagtgcggctcgaggcaggaccaccagtgccgctcgaggcagggcgcagcccctcaggaaagctgcagtccctggaccgactaggtaagaagagcacgtcagcaaacaaagactcaatagcaagccactaccatcttagccatcaaagtctggactctcctctgccagtggtccctaactccagtagctctgtgcccagagatgggaggaagagatgcctccagggctgacctctgaagtagagactatgggggatcgggtgccttgagcttgaggggactcaaccccaccctaccctgccctgaaagaagaagagaggggcagaggtcatctgcccgtggagaaactcacaaacaaaataataaatgcaggcagagtgacctatctgtctccttccatcttgtggtcaggactagagagcttgatcttctaccacggttcactggccattcccatatgagcggccttaggagcccgccggctcagttctctatgacatgtcttcctgactggatactggtctgtttggaaaggccaggaggacagctgatgtacagaacttgtttcctatgaattctttgacttctcacaggtcaatcagttataagcttactcacatcttcatattttttcttaaataaatgaattaaaaaaaaaaa

SEQ ID NO: 319 - DNA, 893 bp, Mus musculus
caggaaggaaggagtgaaaaacaaagctgccgcctccagttccgggtccaggcactttctaggtaatgatggatctacagaggactcagtccttgcttctgctcttggtgctgaccctgctggggttagggcttgtacagccctcctatggccaggatcgaatgtaccaacggttccttcgacagcatgtggaccctcaggcgacaggtggcaatgacaactactgcaacgttatgatgcagagacggaagatgacttctgtccagtgcaaacgcttcaacaccttcatccacgaagacatctggaacattcgtggcatctgtagtaccaccaatatcctgtgcaagaacggccagatgaactgtcacgaaggtgtagtgaaggtcacggactgcagagagacagggaactccaaggcccccaactgtagatacagggcaagaaccagcactaggcgagttgtcattgcctgtgagggtgacccagaggtcccagtgcactttgacagatagatgctatcctgcagctgttacagctgatagttgacctctgagtcagtgagaccaacaatgagtggtggccccaggctttgtttcctttgctcgtgccttatactcacatatatccaatataacccatggtgttaagcgcatcccatccaaggggagaaagaagcctgtgctcacagcactgatggcttggttctcccagattctatcccctggaacttatgcattacatgtattcagatagtatctcaacgattatagagagccttttctgtccaagctgtctcattccagtcctctaacaccccttgagaccaattctgccactgtatttagaagctttgagttaaaggatttgatgaccacaaaaaaaaaaaaaaaaaa

SEQ ID NO: 320 - DNA, 2530 bp, Mus musculus
ggcagaccagcgctgtggagctggaggaacggcctagtggtaccgctgatcctgactgtcccgtgttttaaaacctggctggaaattgtgtgtgacgcattcccagaccatcctgcaaactcaacacagcgacttctctgtgactgggtccagataaaggtcctttcaagactgacttcagtggatctactccaccaggtcttcccgaccttactacatcactgccaagtgctattggcgagactgcctgcaccagcagaagactcaccggatccatcagagcgtcggttttaccagagcaaagcaagagcctgtgtggttctgcctcccgctaatactggacaggaaacagcaactggcttggactagaggcctggctttcctttgaaggagctattctgtgatctgtgttgctagtaagtgactgacagtattctagactggactggtccctgagtacagagactgagttgcaattaagtgaagaataaacttcaagatcttgaagaactgcactaaggtgcaagccaggttcagcactccagtgttgttgaactgacaagttgctaaaggaaactgtaactggactgactgttgcttattgcttccctctctctgtcattgttgctttttgttgttacattgctttgtgttgtctttctaagcccagatgttctccgataattcacactgccctgattgtgggcagcagtggttccctagtttagaactagggcactggttgtaccaaactgaacttgttgaaaatgaatgttaccaagtgttcttagaccgtattaacagggctgactactgccctgagtgttaccctgacaatcctgctaatagaagccttgttctgccttggtctttcccacttgagtgggcacctcaaaatcttaccaggtggacctttgaaaaagcttgccatccatttcttctgggtcctccactggttagaaaaaagatacatgactccagggtagctggctttaatcctgcattacaattaattttgtccagaacagacaaaaccttaaacaagaaacttggccaaagcaaatgacttctgtaacagaatcatggagactctcaagggctttgcgttcgtagcctaggggagaagaggaattaacgtgtttctgttttccttctctttttctttcttataattttttaaggtgctggggattgaatctgggtgccttgtgcatgctaggcaagtgctcttccactaagttaaaccaaggctccccctttctaagactgactcagactgctgttactactctgtcaactgcctaaattgttgggtctgcttctgtggtctatgcatattttagcataaatttagttgatattgcagccagagtatttacctagaaccagactaacctatagcccctataaatgctttagaactacctggcccctcttgaaaatcaccacaacctaagtattgacaagataatgtagtcctggaggggaggccccatgttgtatgccccataaactgtttttctatcagtacctgttatgagaacatgttcttgtagctggattctagattctaataaattttaatacactacattgttctaattttctcctcttatattgatcaataatgagagatgtgtgtatgtacatgtaaatttttttcatatatatataaccattctttgacacttttatcctcagtgtaagtattacagtgttttaactggtcctgtcacatactatttggcaatacctagaccggttaccaaaaaatgtgttaatgctgccagtttacacttacttatctctatataaccaaagactgtcttgtcttgtggtgagtgaactcagtgtcctcccatggaaatggaaaaataacccatgctatggagtttatgacaaatgataaagcttgactccatataactttagagtggtctagtggatgctctgtcttagccgtaagaatgtgctgctgaacattggccacgttctaggattctggtcatggaaatcatggaatcagatttggagttaagcagcttagaaaaggctcctgggaacatctgagaagccactggacattgttaaattttcacttaagattctaggtgatccagtgcctgtgtagaagcagaaatgtcaaggacccaggtggttctctttcctctctagggtctttatggtctttgttctcatgatagtttttaaatgggttcagtatggttcgttgtgccgataattcaatcacaaccagaagcagggggcacctggcttgctttcttacaagtcttaatttggaaataaaatctttttgaaatgactcagcaggttttattgtttttgttttactctcatgagcaggtactgattcatgcactagtctgagaaagacttggcaaaggaggaggaagattgggctttcccttatggcacctcacctccgctgataaaactgacatccatcccttaagtggggaagtggaggactagttgttgatacgcaataaatcttgctttccacatgtgg

SEQ ID NO: 321 - DNA, 631 bp, Mus musculus
cccgcagcgcgctccatcctttgcccttcagtgctgcctttgctccgcaccatgaaccacacttctcaagccttcatcaccgctgccagtggaggacagcccccaaactacgaaagaatcaaggaagaatatgaggtggctgagatgggggcaccgcacggatcggcttctgtcagaactactgtgatcaacatgcccagagaggtgtcggtgcctgaccatgtggtctggtccctgttcaatacactcttcatgaacttctgctgcctgggcttcatagcctatgcctactccgtgaagtctagggatcggaagatggtgggtgatgtgactggagcccaggcctacgcctccactgctaagtgcctgaacatcagcaccttggtcctcagcatcctgatggttgttatcaccattgttagtgtcatcatcattgttcttaacgctcaaaaccttcacacttaatagaggattccgacttccggtcctgaagtgcttcaccctccgcagctgcgtccctccttgcccctccctacacgcaggtgtaacactcatttatctatccacagtggattcaataaagtgcacttgataaccaccaaaaaaaaaaaaaaaaaaaaaaaaaaaaaaa

SEQ ID NO: 322 - DNA, 684 bp, Mus musculus
ctccaaatatattttactgcgctgaacaatatattctggagctgtctaaaacacagccaaatgactttattgatttacatctatcctgtaacttttggaatatcaaggacaagataaaaaaatattaacaaaactacccaattataatcgccctctccctggctgagcttcgtcctgaagccgcactgctgtccttctcagcctgagctcctggtactgctgacttccgagtgcattgggagccctggggtggccccatcttcctctcacagggcagcgacaccctgtttactcccaggtcgcagtgaacgcccttggcatcatagaagctcaggtctgttaaaggaactgactgggggacacttttaagagtagagaatgtacaaaataacttacagagagacagatggctttaagtgtgtgttgtgtggggacacaacgaagcaatctgtcagcaaggggctgggcacttctggtcttgctgtttttgttgttttgctcctttgcagtgagaagtaagtgctggggattgatttccgggcccagtcaacaccagcctggagagaggtgggaggagcctgcagctctggcttccagttcttggaactaaagatgccccaaagataaagcaaggacacaaggagctaatttaaatcagaaatgaaagcaaaatcccacctacat

SEQ ID NO: 323 - DNA, 1482 bp, Mus musculus
gtcctctagccccgcctcttcccgagatgggacccccaaacactccccagggggctctctacacaccccaggagttctatttgtgccaccagagtgcaagctcacccaactggtgacttttttcgaactcccttcctcgcctggaagagaccttctttggctacccgccccttgcccggtggctcctacgtggctactttgcaggatgggctgtataaagggctggaggcagttcaacccaaaccagagacgtggcgtctgctaggcctgcctaagctccagtacctgactaaagtccagagaatggagcagggaggagctgaagagagcgtggctgggagacatgaagacagagctgtggaccacagttggctttcctgggaacactccctaactgtggtctataagatgtaacaagactattactcaattattacaaagaagaaaaaaaaaaccagtgctggcctctttacattgtgttttcctgtagatgagcctggcatatgttacagtaaccattccatagtttattttcccctctggttcccacgattgtctgaccctgcccattttaccacgcctttacactggcacagagaaaggaagtttgatgtctctgtagcattgctcggtgctgcttcggttttatgtactctgtagtactcagaagacccacagtttcagttacagttacaccatgatgtctatcatggatgttgtcacagaggacggcttctaaactagaggggatgcagattgcacagactttcagtgcctcctgtggtctctcaggattcaccaaagcccctttaaggttgttcctttgcccccccccgccccccaacaaagctctctggtcttaaatgccctcttcctgagtggtgttaaggagactagatgtgttttaaaagaacactgtaggagcttagactctcacatctcacacccacaagaaggagcacaattggatatgatacaaagtgcaggttctccatccttaaggtaaatttctaggctgctaggatgtgtgaaagagcctcaagcatggccctctctacagactaatgtcttatttagggtctggcttggcttcccagggctgatcagagaaatgtgacaatggactctgtccctggttattcctgatggttgacatagactgatctaccttcacccaccccaagtgagttctgcttttctgtgacctttgaaattctacccacactaagaatggcattctttcacttcaaggccacatccaaagaaggagctcagttaagtgtccaggcctcagcagtaaatatctgcaggatgtacccagacacacactctagaagatgagcctgtgctctgtaacagggtggggttcactttctaaagttttcttcttccttgacatggtcagtgactcttcaagcttccatcgggatgtcatattttacttaacctgcatttccagaaattaaagcattctagaaatct

SEQ ID NO: 324 - DNA, 4205 bp, Mus musculus
gagtagagcgggcacatcttggagctcgcgcctcctgcggcgtcgcggtccctggtgagccgtagagggccagtgccatgatccgacaagaactctccacgtcctaccaggagctcagcgaggagttggagcaggtggttgagaactcggagcaggcagacgaacgagacaaggagctggtccaagtacaaggtccaggtgtcgtgccaggcgtggacaacgagtccgcctccagcagcatccgcttcagcaaggcttgcctgaagaatgtcttctcggtcctgctcatcctcatctacctgctgctcatggcggtggccgtcttcctggtctaccagaccatcacggacttccgggaaaagctcaagcaccctgtcatgtccgtgtcttacaaggaggtggatcgctacgacgctccagggattgccttttaccctggtcaggctcagctgctcagctgtaagcaccactatgaggttattccacctcttgccagccctggccagccgggagacaggaactgcaccactcagaggatcaattacacccaccccttcttcaaccacaccatgcagtcagccctgattgtccaggggccccaggaagtgaagaagcgagagctggtgttcctccagtttcgcctgaaccagagcaatgaggacttcagtgccatagactacctcctcttctcttctttccgggagttcatgcaaagcccggacaaggcgggcttcatgcaggcctgtgagagtgcttactccagttggaagttctccggaggcttccgcacctgggtcaagatgtcactggtgaagaccaaagaagaggacgggcgagaagctgttgagttccgtcaagagaccagcgtggttaactatattgaccagagacccgcagccgagaggagtgctcagttgttctttgtggtcttcgaatggaaagatcccttcatccagaaggtccaggacataatcacagccaatccttggaacaccatcgccctgctctgcggggctttcctggcgttgtttaaagcagcagagtttgccaaactaagcgtgaaatggatgatcaaaatcaggaaacgataccttaaacggagaggccaggcgacaaaccacataagctgaagcgcccgtgccacggcactccgacagagcgagacaccagcaatcctgaactcacttgaagggaccctgcagggaaggacagtcccgtccatcgcactggaggctcaaacccggcccgggagggaaacgcccagtgaataacctgaaacttatttaagtacttaaattattaacggacatcttgcagagctgcctagtgccttggagaggttcctcctatttggtcactaaatagttaaggcttcttctttcccttagggctttttttctttaaagcggactgatgtgccctgtacgcagaattccttttagaccatctactgttacttaacaagaacttgttagagcctagatttgacttttttgtttttccttaaatgtagccccgctgtaatcactgtgtagaccaggccttcctcgtgccttcccattgctgagactaagagcctacatcactccccgcaagctttacacgagaccttaaaggctactagaaacttgtgattgtatttctgatgtgctagaagtgctagcagaggtatatacagtaggcacctacttagtgtatcttgatttcattaacaggtaaataaggttgggcaagcacaaaagggatgggagtgaatacccagtaagccagcgggcagcaacgctggacgctgatgctgtatggccagcaaacccagaaggtagtgtaagtctggaccgcagcataatggctctgactcagcacacatcactgccaacagggaggtaagctgtgcactgtccacaggtggccaagagggatggccacaccacatgagctagtccctgcgtcctacagaaacacacacctaaaagggtggcctttagggctttgataaacagcacctctacataaaaccaaaaactctataatagagttccacatgtggccagaggtaacattgaagaacttgtaattatgccttagggaatcggaagggaaatactcacaggtataaggaggacatttttgtctctaaattagcagcaagaaactgttttgcccaaatccctagaaataaacttgtactgtgaaatattcctgctacctttgtctcacatatatacaagaatttagatttttagcctaaaacttttattataaaacaccattttagcacaaatgccaagcataaagcatcagtgacattaaaaatatgtgaaggacagaaagtcgaggggcaggggtgcagtccagtcacaggatgtgtgcttaccacgcagggcccttaaagttcacagttgcatagcacttcagtagttaaatatctgcctcagtgaacactaaagctttattttcctgtattgtgaaagctgagctgcttttaattttgctttagataactaggaagtaatttttgcctattcatagaataaaaacccgacttccactttctggaaaggcaaccctgtgttttgttttgtttttttttaagatttatttatttattatatgtaagtacactgtagctgtcttcagacactccagaagagggcatcagatcttgttacagatggttgtgagccaccatgtggttgctgggatttgaactcctgaccttcggaagagcagtcgggtactcttacccactgagccatctcaccagcccgcaaccctgtgttttgtgtgggtcgcccagggctattctgcagaggcctaaagggagcagcctcattggactgcaacaatggccctccctgggatgcccactgcttgaaaagagagcaaaaattacaggccactgtattacaagggagtttgtccagaggtcatggaggctgctgtcacagcaacaaaaaacccctgtgacccttctaaactggtgtttagttgaaaccatgttacagtctccctgcctttcccagaactgctactgccatggattctgagatttcccgttttagttaaaactagctttaatgttaaactgtcctagaacacggagggacaagaagcttgggattttatgaaaagatcggttagatggctagactcctaatccctggaccacaagcaacctaattctaattagagtacatccgtaagttataattctctaatataaatatcttccagagacaaaagagcaaatgacataaggcaaaatacaaacatagactttattaaatgctgctcaatcctcagtaaagatctctcattataaaacagttttccatacaactgcaaggcaagaggctggaatggtactggtaacaacagtgtgaaaaatacctgaccaggtaaaaacagacaaagcttctacatagtcagctctgaggacacctgctgcagttcctttaaataaagccaggcagtgacagctagcagtctgcatcacactgtgggagggacccagagctccaccctgcaggcaggcaggcctggggactggcagggtgaggactgggaaggccctgcctccagccttggaggagaggaatgaaggaggtgagcctcgggtccacccgtggcctgtgctgctccgcacacgctccggggagccgctgctgaaggggggatttgggaacatcagaattttggtttacttcccccccccaactttaatactttgtgcttcagaagcctggaaatgtcagatgttgtaaaacccagagtatggcagtgtctttaatgaggctgggctcttgtcccctgcccacacctctctaggagaggtgagggaagggcaacccctccgcttatcttacgaggctctttcctcagatgtactcaaggtgtgcagcaccaaggtgtgcagcacggtgaaaacacatgataaaggaagtgtgcagaggacggcttcatctgtgtgtgcagcacaaccgggctcaagtcgcaacacacgcttgccactcccacgatcacctcactcaacagagacagtgacacaatccatgattagacagagtttacaatatactgtggccgtgatacagcacagggctatgttttagtccataattctttcgcttttacgcttgccaggaaaaactggcctcctaattatattatactgatgaggtctgctctgaagtttttatatattc

SEQ ID NO: 325 - DNA, 469 bp, Mus musculus
ttttttgctcttctcattttattgaaaaccatggtggatactgagaaatcccaggtgatcccgtcttctgtctcctgaaaagacaatggtctgctgggctcacagcagcagcggcagagtgggcagcccttcaggacagtccactgtaccctcacaccagggtatggaatatgtccactttttcccggtacagctggtagaactgcttggccagacagtggaacggggcctcgttattatccatctccttcacagatgtctcaaagaattccaggccttgactcagtgcccatacctgggcctgagctgaatccactgtttgtcggccagccaggtctgtcttagttcccactaaaacacctgggagggagatgcctcgagtctgagactcgaccttctccaaccactttgtgcagctgatgaagggactgttattgttcacatcatagacaaggcacaggacgttggg

SEQ ID NO: 326 - DNA, 1050 bp, Mus musculus
gaaggcgggttgatgatggttgccaggagcctgtttggcgcgactcttgggaccagaggactagtggttgtgtctcaactcttctttgggccgggtctaaggctggacttggaacgggttctgctccgccccaccggaacctttgcaggctgcctggggcctgaagccctccgtccacccaaccctagcacccgggccatcatccatccctccatcacggcctcaggccctggtgtcagctgtccccgaatcctaaccccctttcagcgtcccccacccccacgtctccgctagtacctggttactatggtgaagctagctgccaaatgcatcctggcaggggacccagccgtaggcaagacggccctggtgcagatgttccgcagcgacgggacccatttccagaagaactacaccctgacaactggagtggatttggtggtgaagacagtgccagttcttgacacaaatgacagtgtggaactcttcatttttgactcagccggcaaggagctgttctctgaaatgctggataagttgtgggagaatcccaacgtcctgtgccttgtctatgatgtgaccaatgaacagtccttcatcagctgcaccaagtggttggagaaggtccggtctcagacttcaggcatctccctcccaggtgttttagtgggaactaagacagacctggctggccgacaaacagtggattcagctcaggcccaggtatgggcactgagtcaaggcctggaattctttgagacatctgtgaaggagatggataattacgaggccccgttccactgtctggccaagcagttctaccagctgtaccgggaaaaagtggacatattccataccctggtgtgagggtacagtggactgtcctgaagggctgcccactctgccgctgctgctgtgagcccagcagaccattgtcttttcaggagacagaagacgggatcacctgggatttctcagtatccaccatggttttcaataaaatgagaagagcaaaaaaaaaaaaaaaaaaaaaaaaaaaaaaaaaaaaaa

SEQ ID NO: 327 - DNA, 1291 bp, Mus musculus
aggagctgccgtcctccctgctggcctggcgggtcctctgtgcatcctccctgcaccttctttttccaagggcggcgttaacctccccgggtcgagccggagcgctgcgcctgcagcagtgactagacgttttggatttacgattctattttgtcgttcggtgctcgtagctctattttccatgacagatagtgacgacactacgtgcaaaaggtatataaagatgattaccaatatagtaatactgagcctgatcatttgcatttccctagcgttctggattatgtcaatgactgctagcacctattatggtaactttcggcctgtttctccgtggcgctggctgttctccgtcgtcgttcctgttgtgatcgcctgtaatggctttaaaaagaaaagtctagatcacagtggggctttaggagggttggtggtcggattcatcttaaccatcgcaaatttcagcttttttacttctttgatgacgtttttcctttcatcttcaaaactcacaaaatggagaggaacataaagaagcaactggactcagagtataaggaaggaggacagaggaattgggtccaggtgttctgtaatggcgccgtgcccacagagctggccctgctctacatgatagagaacggccccggggaaatgcccatagatttttccaagcaacacactgcttcctggatgtgtttgtctctcttggctgcgctggccagctcggctggagacacctgggcttctgaagttgctccagttctgagcaaaagctcacctcggctaataacaacctgggagaaagttccagttggaaccaacggaggagtcacagcagtgggacttgcctccagtctcctcggcggtacctttgtgggcctggcctacttccttacacagttggtgtttgtgaacgacttagacatctctgctccgcagtggcccattattgcatttggtggtgtggctgggttatttggatcactcgtggactcgttcttaggggcgacgatgcagttctctggtctggatgaacgcacaggcctggtggtgagtagcccgacgcaggagacgaagcacatagcggggaaaccgatcctggataacaacgccgtgaatctcttctcctccgtcttggtggccctcctgctccccacagccgcgtcggggttttggccccgagagtgaactttcttttccttcccaagcagtcgatactggtaaggccagccagacttgcaatgtgaagggttttttttcagtgaataataaattcagggaccttggg

SEQ ID NO: 328 - DNA, 655 bp, Mus musculus
  modified_base (39)..(39): a, c, g, t, unknown or other
  modified_base (53)..(53): a, c, g, t, unknown or other
  modified_base (55)..(55): a, c, g, t, unknown or other
agaaaagagtgggtagtaggatcaagaaaaagaagaaanaaagaaagagaaanancgctgtagatagtgcatggatgagaaactggaaaagaacaggaaagggtatcaagacagaagacagagggccactgatgagagaaacagcttctagagaacttgagagatggaaacaaggtgtgaccacaagtctgaaatcacagtactctgcatgctgaggcaggaagattgtaggtttgaggccagcctgggaaggagcaccaacctagaaaaacaactacaacaacaaaaatgcatagagttatgtggacacaatggattgttttctttctttttttttagctgtaaagaataaatcatgatagctgcagaaaaaatggatataactggaagtcatgtttggtagaataatatacagacaaatgcttaatgttttcttttatgcaaaacttagattcaaacgataaatatttgtgtgtgtgtttgcatttatatatttataagttatgaaaatataggggtcatgggccaggtatggtggtgcacacctttaatcccagcacttgggaggcaaaggcagacaaatctgagttcaaggccagcctggttttccaagcaagtccaggacaggtctgttacatagagaaaccctgtcttg

SEQ ID NO: 329 - DNA, 655 bp, Mus musculus; identical to SEQ ID NO: 328
  modified_base (39)..(39): a, c, g, t, unknown or other
  modified_base (53)..(53): a, c, g, t, unknown or other
  modified_base (55)..(55): a, c, g, t, unknown or other

SEQ ID NO: 330 - DNA, 2793 bp, Mus musculus
gatccattgaggagctgcctcgcacagggggtgtgctctcgcggagtcctagggactgtgagcaaacccagtcttgaataatccggcgagaaacaccgggttggatccgaggtgcagcctcagagggaaggattaagagccgctagactttttttcttttccctttttctcctctcagtggcacggagtccgaattaattggatttcattcactgggtaggaacaaaactgggcaccttcattcagagagagagattcattgactcggagagtgatctggtgcagagggaccaccgacttgacttctgtgtcgctttccctaaccgctagcctcggcttgggaaaggcgaggcggaatcaaaccccgctccgagagcgggagcttcgcgcagcgtgctcggcctatgcctgcctcgaggggcgtctgctaggcaccccgccttctcctgcagctcgacccccatgatagatacgctcagacccgtgcccttcgcgtcggaaatggcgatctgcaagacggtgtcgtggctcaacgagcagctggagctgggcaacgaacggcttctgctgatggactgccgaccacaggagctgtacgagtcgtcacacatcgaatctgccattaatgtggccatccccggcatcatgctgcggcgtctgcagaagggcaacctgcccgtgcgtgcgctcttcacgcgctgcgaggaccgggaccgctttaccaggcgctgcggcaccgacaccgtggtgctgtacgacgagaatagcagcgactggaatgagaacactggtggagagtcggtcctcgggctgctgctcaagaaactcaaagacgagggctgccgggcgttctacctggaaggtggcttcagtaagttccaggccgagttcgccctgcactgcgagaccaatctagacggctcgtgcagcagcagttccccgcctttgccagtgctggggctcgggggcctgcggatcagctcggactcttcctcggacattgagtctgaccttgaccgagaccccaatagtgcaacggactctgatggcagcccgctgtccaacagccagccttccttcccggtggagattttgcccttcctttacctgggctgtgccaaggactcgaccaacttggacgtgttggaagagtttggcatcaagtacatcttgaatgtcacccccaatttgcccaatctgtttgagaatgcgggcgagttcaaatacaagcaaattcctatctcggatcactggagccaaaacctgtcccagtttttccctgaggccatttctttcatagatgaagcccgaggcaaaaactgtggtgtcctggtgcattgcttggcaggtatcagccgctctgtcaccgtgacagtggcgtacctcatgcagaagctcaacctgtccatgaacgatgcttacgacattgttaagatgaagaagtccaacatctcccccaacttcaacttcatgggccagctgcttgacttcgaaaggaccctgggactgagcagcccttgtgacaaccgtgtccccactccgcagctgtacttcaccacgccctccaaccagaacgtctaccaggtggactccctgcagtctacgtgaaaggcacccacctctcctagccgggagttgtccccattccttcagttcctcttgagcagcatcgaccaggctgctttctttctgtgtgtggccccgggtgtcaaaagtgtcaccagctgtctgtgttagacaaggttgccaagtgcaaaattggttattacggagggagagatttgctccattcattgtttttttggaaggacaggacatgctgtctctagatccagcaataggtttgcttctgtaccccagcctacccaagcagggactggacatccatccagatagagggtagcataggaatagggacaggagcatctgttctttaaggccttgtatggctgtttcctgttgcatctggaactaactatatatattgtcttcagtgaagactgattcaactttgggtatagtggagccaaagagatttttagctctgtatttgcggtatcggtttagaagacaaaaaaaattaaaacctgatacttttatctgattattgtaaatatttgatcttcaatcacttgacagtgtttgtttggcttgtatttgttttttatctttgggcttaaaagagatccaaagagagaaagagcagtatgccacttcttagaacaaaagtataaggaaaaaaatgttctttttaatccaaagggtatatttgcagcatgcttgaccttgatgtaccaattctgacggcattttcgtggatattattatcactaagactttgttatgatgaggtcttcagtctctttcatatatcttccttgtaactttttttttcctcttaatgtagttttgactctgccttacctttgtaaatatttggcttacagtgtctcaaggggtattttggaaagacaccaaaattgtgggttcactttttttttttttttaaataacttcagctgtgctaaacagcatattacctctgtacaaaattcttcagggagtgtcacctcaaatgcaatactttgggttggtttctttccttttaaaaaaaaaatacgaaactggaagtgtgtgtatgtgtgcgagtatgagcgcccatttggtggatgcaacaggttgagaggaagggagaattaacttgctccatgatgttcgtggtgtaaagttttgagctggaatttattataagaatgtaaaaccttaaattattaataaataactattttggct

SEQ ID NO: 331 - DNA, 1356 bp, Mus musculus
ccacgcgtccggtggcggtctgagcaagctgtcgtccggaccccagacctgcaggtatatcatgtataaaagtggatcaattccatgttaagtgaaaatggccaattcgttacgaggagaagtactgactctttataaaaatctgctgtatcttggacgggactatccaaaaggagcaggctattttaaaaggcgtttgaagaacgttttccttaaaaacaaggatgtggaggacccagagaagatcaaagaacttatcgcacgaggagaatttgtaatgaaggagctagaggccttgtacttccttaggaaatacagagctatgaagcaacgttactattcagataccaaagtctgaccaatcattgcaccagtcgagctgacaaccagtgctggctgtttgcctgtaccaactattaaaaaataattcagtttaaaagggtgagatacatggtttttaaaaaaatgagttgccctactgtactgaaataggtttcaaccttattgatactgagagctttgcccataatccttttattactgaaatagtaactttagtacctttcatgataatataattttgaaagaaaatacacttaatttttaaacatgttatagccaattttcttagtctatttcttcatttactgatgagattgtcactatcgaatggtgtctgacaggcttgccctttagcttctagagtgtctttgtccttgttttttgttgttttgttagcccatctagtatactaaagtgcatattcaaggctctctacagacacctcaaaatgatttaaatgcagttatcaaaataagacatgtgaaggtgacctctatcttgagaagctcagtgggtgactagcattgtgtagctattattcccattattctttgtgctgctggcctgccttaagttctgaatcacttcaagtagctttcatgaggagttgtaatggtcctctatttctgccattaaagctggtatattttctgtcgacctgtaaccgagtccatgtggcagtggacctaacccaggcaggactgtaagtttaagcaaaaatgtttatgtaatgtttttagcaacgttataaataacatttctaacttaaaagctgcaaatagtgttgcttataggattctgtatcaggctggagagatggctcagtggttaagagcactgactgctcttccagaggtcctgaatttaattcccagcaaccatatggtggcttacaaccatctgtaatgggatcttgtccacttctggtgtgtctgaacacagacagtgtactcatagaataaataaacaaacgaataaatcttaaaaaaaaaaaaaaaaaaaaaaaaaaaaaaa

SEQ ID NO: 332 - DNA, 1089 bp, Mus musculus
ggtatcgaccacagatcatggctgccctggaggccaaccccacagcccgcaggacccagctacagcacaagtttgaacaggtggtggctctgatggaaaacaatatctatgagtgttacagcgaggcctgatgcagaagagtgaccaggagcttcggccagggagacggcgtgcaggccacttggcctccacttggtttcttccccacatctctcacttgggctgggaactgacagaggagcctgctgggctaggagtgggggacactggcctcttagtgcccggctgccgagctcttggccttgtcccctggggcatctctgtcccctccacctgcccaagacccaactctaggatgaaggccttgaatatcgatcgctgccaatccctaataagactttccctgccaaccaggacagcctggaccatgcctgcctgttcactgtttcaggctgctcagcacacattgggagaggtggccatatcccagaacactacctcatccacctggcagagggaatttctgcttcagccaccaagcagttgtctgtgtccctcatccagagggggccttggccaccaacagttccaaaccaggtcagctgttagccgtctcattggccagtggcagcatgggcagtgcccattgcccacagaacggtggagagagggggacaggctgggggttcctggccccaggaaagggaggaaggcgaggatgcagggctgtagctggactactcagtcttcctggaagtgtttctaaagagcaccacttttttttgttttttgttttttaagaaaaaaaaacttttatatattaaaacaaaaacttatgcaccaactgtgaatagctgccgcttgtgcagatccccaggggctcccggtgacacactggaaatgactgttccaggggacagaaaatactcatctgtccccagcacagcccccaccccaccccccatagctgctgagactggctcacagcccaagggggctgggctggaggggaaggctgggactctctggaacattctttataataaaagcctgccgggaaaccctaaaaaaaaaaaaaaaaaaaaaaaa

SEQ ID NO: 333 - DNA, 2113 bp, Mus musculus
gctgtcagggccccggcgtcgtggtgcttgggtgctcgccaccggctggcctcgggtgcgacctggtcggcagccagaggctgcgcttagctcgcgcgtcccctccctcggccgagcccgcgcctcctggctcgcaggccgccccttagcaggtcgtcccggagccccgggcccagccgctcgtcagcaccgaggccggcgggatgcagcctccgggcccgcccccggcctatgcgcctgccaacggggacttcacctttgtgtcttcggcggacgcggaagatctcagcggttctatagcagctccagatgtcaaattaaacctcggtgtaagcggagatttcatcaaagaatctacagctactacatttctgagacaaagaggctatggctggcttttggaagttgaagatgaggatcctgaagataacaagccacttttggaagaattggacatcgatctaaaggacatttactacaagatccgctgtgttctgatgccaatgccatcgctgggttttaatagacaggtggtgagagacaatcctgacttctggggtccactggctgttgttcttttcttttccatgatatcattatatggacagtttagggtggtctcatggattataaccatttggatatttggttcactgacaattttcttactggctagagttcttggtggagaagttgcatatggccaagttcttggagttataggatattcattacttcctctcattgtaatagcccctatacttttggtggttggatcttttgaaatggtatctacacttataaaactgtttggtgtgttctgggctgcctacagtgctgcttcattactcgtaggtgaagaattcaagaccaaaaagcccctcctcatttaccccatctttttattgtacatttattttttgtccttatatactggagtgtgatccaagttgtacatgaatcaaaaagatggtgttacatttgtattacgctgggaattcttgctggagggattggagaaaatattactagtaaaattttatacattccagatagagaggcaggcttaaagtctttttaaaacaatattttttgtatttaagtaattgcagttatctgggatttttttttcttttttttggtcagaattctgaattctgtttggttcttcatattccgcgaataaataaaaagcgttgtgtttttcagattgtgtcaatattcacctgaacacttgtgccaaaagcacctggatggggagttgtgtttcacatgaagtataaatttgacaacatcctgaaaaatctaaaagtgcaatttttttctttaaagaattttctctggcaccacagatcctgtagatacctatttatatttatacatatatatttatgaaataattcttattcacaaaatatatttctgaatagcctaaaaattaagatactaaatctgatgcttaaattttctttaatttggctattactgttttttgtttaaaacttaaaacttgctttttaaattgtgtatagattttaatctaatagttgctggtatagatttggactgtgtgtgtgtgctcttaagaaaacagttttgaatgtctaaacatttgatttaaagttccctgtttatctttttgaccaaaggagcaagagatataatggatatggcattcattaaaatcattaatatataggaaaaataatatttatagcatcagcaaatatttttaagtggtatatgatcttggacaatgttatatgaagtagaaaataaaatgttttccagctgtgtgttttgttttacaataccttgtcctatattacttgagacttttaacaagtattgtttttttctaacatatttacagtttttgctaggggaaatattaagaaaattttatcacagtttttttgtaaatcatggattctgtatatatctctaatattactttgtaaattagacaaactattttatctgtgtctacaaaatagcaaatccctgttagcaaattattgtattattctttctgacattgcccccaaaaggttaacttctgttcctgatatggtatgacatcgtctctgtgttccttaggcaagacagatct

SEQ ID NO: 334 - DNA, 883 bp, Mus musculus
cggacgcgtgggcggacgcgtgggtcccaggctcaagcaccatggacctggggcttgcaggtcggcgggcgctggtcaccggcgcgggcaaaggcatcgggcgcagcactgtgctggcgttgaaggcggctggtgcacaggttgtggcggtgagtcggacgcgagaggacctggacgacctggtccgcgagtgtcctggtgtggagcctgtgtgtgtggacctggccgactgggaggccacagagcaggccctaagcaatgtgggacccgtggaccttctggtgaacaatgctgctgtggctctgttgcagcccttcctggaggtcaccaaggaggcctgtgacacatccttcaatgtgaatcttcgggctgtcatccaggtgtctcagattgtggccaagggcatgatagctcggggaaatccaggagccattgtgaaaaaatacagccaggcctcccaacgtgcactgaccaaccatactgtctactgttccaccaagggtgctctttttttgttgaccaagaggatggccctagagcttgggccccacaagagccgtgtgaatgcagtaaaccccacagtagtgatgagacctatgggccggaccaactggagtgacccccacaaagctaaggccatgctggagagtatcccactgggcaagttcgctgaggtggagaacgtcgtggacaccattctcttcctgctgagcaaccggagtggcatgaccactggctccactttgccagtggatgggggcttcctggctacctgagccccctgcccaccgacactctgctcagctctctgctcaggacactgtgccctccgcccctgcaataaagctctctgctcaaaaaaaaaaaaaaaaaaaaaaaaaaa

SEQ ID NO: 335 - DNA, 366 bp, Mus musculus
ccttctcaggtttctcgagcttttcaagctttttcgactccttggcattctgcgagggaacgctatccacctgccgctcctcctccccctgagaggaggcgggctggctgaggtcatacttgtcttcatattcgttgctgagaattctgtccttctttttgggcagcttcccctttactggcttgtgaggacctggcaccgcatttgggtcctgatggccatgttcccgtttgtctgtccggttgtcccggaaacggcttgtgcccacaactcttgcgctgacctcccagagggtgggaggtggggtggctgtgaacttccatagttggtggctttgctgggcctcctggtggcctgtggcttctc

SEQ ID NO: 336 - DNA, 700 bp, Mus musculus
  modified_base (68)..(68): a, c, g, t, unknown or other
  modified_base (97)..(97): a, c, g, t, unknown or other
agcttaacgcacttcacttcgtggaaggtgctgctgctgggtggttctgcatgtcaggcagctcagcntatgctgctagaagaagggctcagtacanagtgttcaaaagtggcaaaggtgtttgctttgtttgttttgttttcctagaaaggaaaaggatgcaggatctaaaaccttctgattgaatagcctctgcttgtgtcccattggtcccctcactgcaagctcgattgtgatttttatgtcaaaggaagccaaaatttgcaatactatttttagcagacaaaaagataactcggtataaaatgtataaatatttttgacttgaacattttgggtgtctctgggtgcaagaagaacattaatcccttcagggggatgtttggagaacaggaccggaggaagggggttgttttgaaggcactgtccaggggttaaagtagcatcataattcatgactgttaggaattaagttaataaagtcagtgctcccctacctctaaggaggccttcacagaaccactgagctagagcagacaccacatcttggctttctttttagggaggaggaggctttggtttttggtttcttttggtttccttttgttttgtccctccagcatcctcctctctctgtgctgtgacccccgtagtgacaagactgttactttgtagccatggctgaaaacattgtatctat

SEQ ID NO: 337 - DNA, 6370 bp, Mus musculus
ggccgccggtgctgggcgaggtcggagaaagtccgcgggcgccggagctcggggacgccggagcacttcctgccgcgggcggcgccgctgctgcccaggccggactgggccgggtgcccgcagatgtgcctcatccaggctgccccacgttgagtctgagacccacccaccacagcacccaccatgtctcagatgctgcacatcgagatccccaacttcgggaacacagtgcttggctgtctcaacgaacagcgcctgttaggcctctactgtgatgtgtccatcgtggtcaaaggccaggccttcaaggcccaccgtgccgtcttggccgccagcagcctctatttccgagacctcttcagtggtaatagcaagagtgcattcgagctgccgggcacggtgccgcctgcctgcttccagcagattctgtccttctgctacacaggtaagcttaccatggcggccagcgagcagctcgtggtcatgtacacagccggcttcctgcagatccagcacatcgtggagcggggcacagatctcatgttcaaggtgagctcaccccactgtgactcgcagaccgccatgatcgaagatgccagctcggagccccaaagtccctgcaaccagctgcaaccggccactgctgcctatgtcacgtctccttctgtgcccatcccgcttctgacccgtgtaaagcatgaagctatggagatgccgccggccagtggcccgggcctggcttctaaacgcccactagagacgggccctcgagatggtgtggcagtagctacaggtgctgcagggacacctggcacggcccctctgaagctgcctcgagtctcctactatggtgtgccaagcctggccactctcatccccagcatccagcaggtaccctatcccccgggggagcggaccagtcctggggccagcagcctgcccaccactgacagccccacctcctaccacaacgaggaggatgaagaggatgacgaagcctatgataccatggtggaggagcagtatggccagatgtatattaaagccacaggaaactatgcagtgcaagagaaaccagagccagtgcccctggagagccgctcctgtgtcctcatccgtcgagacctggtggcacttcctgccagcctcatcagccagattgggtaccgctgccacccaaagctctactcagagggagatcctggagagaaactggagcttgtagcaggctccggggtctacatcacacgtggccagctcatgaactgccacctgtgtgcaggggtgaagcacaaggtcctgctgcggaggctcctggccaccttctttgacaggaacacactggccaacagctgtggcactggcattcgctcctccaccagtgatccgagccgaaagccactggacagccgagtcctgaacgctgtgaaactgtactgtcagaactttgcccccagcttcaaagagagcgagatgaacgtgattgccgcagacatgtgtaccaatgctcgccgtgtccgtaagcgctggctgcccaagatcaagtccatgcttccagagggtgtggagatgtaccgtagcgtcatgggtgcgtcggccgccagcctgcctctggaccccgagttcccatctgcggctccacaggtgtttgagcagcgcatctatgctgagcgacgaagtgatgcagccaccatcgtggctctgagaactgatgcggtgaatgtcgatctgagcacttcagccaaccctgcctttgaggctaatgaggaggtggatgggggtggctctgttatccaggaggtggctgccccagagcagctgcccgctgatggccagagctcccctcaggcctttgagcagggcaacaccagctccagtaggcctcagacaccagtggccacagcaacaagaaggccagagggcacctatgcagggaccttgtaagtggccggcaaggccagctcacaggaacccagtactaaagctgcttgcatgcgttactaatacaaacaaatgtgatcaagccacttacctactgaactgctactgctgcctgacaaaaatgtgatttttattctgcctgtatttaaaatggatgaaggaaacaaatgcattcattatactgtaaacatttaggccgctggccactctctgggacaaaggtcccagggcaactttttgatattccccagctcagtctcccgtggtagtgttctctctcccttcttggggagacagaagagggcaccgggtccctgatgtcctgccctgaccctgcctcatccacccttcttattcccctgctctgaaagcagaagctggggcagcagtggcctggggctggaggggcagacacgacactccattcttaaccataaggaccccactgggacagtggggggaatgctgggcccccagaggccagacttctcttgttttcattcctccgaagaagctgcctgcgtgcatgtatgtatgcgtgtgtgtgtgtgtgtgtgtgcgtgtgtgtgtgtgtgtgtgtgtgtgtgtgtgtgtgtgtgtgtgcatgtgtgtgtatgagtatgtacgcacacacacatgagtgagagagacagagagagagaaagagaaagagggggggcaggaagaccagtgatggccctgcagtagctgtggctggtcatctgggggtgggggaaagatgaggtgttcccccctccatacctgtgtcctcactctgctccacccagacccccagcggctggcctgctgatccccccagggtctctctgcccctggccatggctgtcctcaccaccctctgcctctccagccactctgggattttgcttgtttgctgtttttgtttagttcagatctattttgtttgtggtttggaaactttcagaccgaacagagaaaaaaaaaaaaaaaaaaagaaaaaaaaaaagcgagagactagtgtccctgttcccagcctgctgtggatttgggtgaatacatgtccataacccccatcttggcctcccattggaggcagaggggcccaggaaagtatagctatctgtgtacagccaagctaggcccctgtggacctggccagcaggacactgctgcctggggtgggcttagcgctcactgtgggtgcccgtgtagtggaaggcacaggccctacaggcctgggccagggcagttggcaggtgtggatcaacctcactggggaccagaaacttagactatcacgaggacggcacctgtgggggccgtggaggactgctggtgggtgagaagctggcggtttatcattttaaagtgtgggatatgctcccgaggctactttcccaagtgtctcctcttggactcttgtctgaggactgcctgcccacctgcaaaacctagcagctgctgaggtgcccaaggacaccgactataacaaacttgaaaggtctcgtccctatccctctatgcatcttgagtttgctgccctatgaaccccccactgtgtgcccacagtcagagcagtcttttccccattggagggtaggaggcctgaggtgcagtttagactccctctgtgtcacagcctcctttttgcaggcaattccctgtcttgggggcctcacagggagaccccatactgtgctgactatacacgtcaattcatgtatagtcctatcttccccctcccctcttttggaagacctgtggtgtggagagggaaaggggcatcatggcaggcactgtgggaactgagctgagcccctccccctgctccttggtaacccaaggcctgcattcctagggccggttcagaggctagctaatatccagctcaggaactagctgcccagagatggacctctcacctctcccatttccatcttactcctaggtaggttggagccccagccagccctttagtgacttggaccaaaccctcctggtgctgggtgaagaccatagaactgtagagggtacggcaggattgggggcagggctgtgcccttccgctctggaatatcccttcatctgcttcctccacccaaatttgcactttaatttgaccatccttggggacctttgggagacaaacccacctattttggttggtggtagaagggctctttctcatccctccactccaagatgagcatggtcccaccctgggccagcatagggagggtgccgctggccattagaggaacagtggccgcacagaatgcctgaccactgctcgggctagcacaatgtcctcaacctctgtcccttagtgtttataattgccatctgttttgttctgggtaaggaaggcaagagctataggtaaaacttcaataatattaaatgtgaatggattctgagctctccctgtgccccgggtgggccagacagagcgttttgcactaatgtgtcccattgtggacgttgtggggatcgtttgcagacatgcatggccaatgactgtacctgcttaggggaggggcactccctctgcatcctgaatgtactgcgaggcaggcgggtggcaggcctgggctccgaggggccttccagagtgccttagcatcttttgattatttttttcaaggaaaaccaatttaaaaaaccagactccctcctttgtttacaagatgactaattccagaatcggggctgtcttgtcctgtcacgtgaccctgacttgtccagaccctataggtgagagcctctcagcatttgtcagatgtctacacctctgttcctagcttgactactagcaatatgcacatactatgtagagtctattgtagaaactattgctacatcagcatctttgccaggacgacagtcgggactggatagggttggagctactgggacagagctggatccagccatgagtcttatgtcctcccagagcagacaatagtccctgaggcagctgggacgaatacagcaggtctggggcaagggaccagagacagggctgatagtgtgagcttggaggtgctgcctgtctgcccggctgtctcagtacttgaattctgtattgttttctataccagttgcttcagctaacatctgatttggtgtcttactttgcccttggatgtagatgcagccagtgatgtatgaaaggcaattgaggagagactctgaggggtcctttgtggtgtgactgcaggtgtgggcctcgaagaaaactagatgtgtggtgtttgtttagaacctaaaggaaggcagaaaggggctgtgagagctggcaagctgacagggccagtcccctccaagggactgtggggtgcctgctgctacctgcttcaacagcaggaccttcccaagcccagtgcatgttgtgctctgccccactgtcctctgcttgggttccctaaagatggtgattcttagctgacttggggaagagcaggtggcctatcaaccagctgaaaactcgaaagaccctgttagaacctgcttgccgcagatcccagatgggaatggcgacaagcacatgatctgtcagctttacgcacttcacttcgtggaaaggtgctgctgctgggtggttctgcatgtcaggcagctcagcctatgctgctagaagaagggctcagtacaaagtgtttcaaaagtggcaaaggtgtttgctttgtttgttttgttttcctagaaaggaaaaggatgcaggatctaaaaccttctgattgaatagcctctgcttgtgtcccattggtcccctcactgcaagctcgattgtgatttttatgtcaaaggaagccaaaatttgcaatactatttttagcagacaaaaagataactcggtataaaatgtataaatatttttgacttgaacattttgggtgtctctgggtgcaagaagaacattaatcccttcagggggatgtttggagaacaggaccggaggaagggggttgttttgaaggcactgtccaggggttaaagtagcatcataattcatgactgttaggaattaagttaataaagtcagtgctcccctacctctaaggaggccttcacagaaccactgagctagagcagacaccacatcttggctttctttttagggaggaggaggctttggtttttggtttcttttggtttccttttgttttgtccctccagcatcctcctctctctgtgctgtgacccccgtagtgacaagactgttactttgtagccatggctgaaaacattgtatctataacaacaacaaaaaataaaacaaacaaacacagctatgtccgcaagccgaccagggaaaccctagagctttgagcctgtgctcagagctgtttcagaagtggaaatccatgacaaaaggatgttctcgttaactgtaaggcgctttgtaaagttcacatttacagaataataaagtcaattcaaaccc

SEQ ID NO: 338 - DNA, 730 bp, Mus musculus
gacacactgaggttcctgtgtttggaaatccgaagatgcctgagcctgcgaagtccgctcccgccccgaagaagggctccaagaaggccgtgaccaaggcccagaagaaggacggcaagaagcgcaagcgcagccgcaaggagagctactcggtgtacgtgtacaaggtgctgaagcaagtgcaccccgacaccggcatctcctccaaggccatgggcatcatgaactcgttcgtgaacgacatcttcgagcgcatcgcgggcgaggcgtcccgcctggcgcattacaacaagcgctcgaccatcacgtcccgggagatccagacggccgtgcgcctgctgctgcccggggagctggccaagcacgcggtgtcggagggcaccaaggccgtcaccaagtacaccagctccaagtgatcctgccaagaggagcagacctgacatcgtttgtaccactcaacagtgctggatgctgtaacctcaagacagtgcaaatgggtgatactagcagattaaccaccatagtttcagaactcaaggaacaactgagaagcaccattttaaattctataaaaatgttcactgtagaaatttgtgataagaaagacacacagacgtagaaaatgagaatacttgctgcaaaattaagatgctcctagcaaaagaatgcttttaagtgtttgtcatgtatggatatatatgatgtatatataataaatgtcatgtaaagc

SEQ ID NO: 339 - DNA, 1174 bp, Mus musculus
cggacgcgtgggtccgcggaccgaccgagcgcaccgaccatggcctccaagtgtcccaagtgtgacaagaccgtatacttcgctgagaaggtgagctccctgggcaaggactggcacaagttctgtctcaagtgtgagcgctgcaacaagacactgacccccggcggccatgctgagcatgatgggaagcccttctgccacaagccctgctatgccacactgtttggacccaaaggcgtgaacatcgggggcgctggctcctacatctacgagaagcctcagaccgaggcccctcaggtcactggccccatcgaggtccctgtggtgagaactgaggagcgaaagaccagcggcccccccaagggtcccagcaaagcctctagtgtcaccacattcactggggagcccaacatgtgtcctcgatgcaacaagagagtgtacttcgctgagaaggtgacctctctgggcaaggactggcaccggccctgcctgcgctgtgagcgctgctccaagaccctgaccccaggcgggcatgctgagcacgatggccagccctactgccacaagccttgctatggaatactctttggacccaaaggagtgaatactggtgctgtgggcagctatatctacgacaaggacccggaaggcacagttcagccctagatctgcagatgctgtcctcggggtccccctgtttgacccggaggcaaagtggcctgttgcctagtcctgcctcagcgtgtctcgcctgcaaatccgggacctaagtggtggaggagaaagcctggatagtcccagagcttcagccccctttgtcaccttggcgtgtcccgtgctgcccaccgtttacttcctgtctgtgtgcctccgtagccccatgggtcctgtgttcctgtgtccctgatagctctccaaggtgactgtcctatgatatatccctttgcccacacctgcccaccagtattatttatgctctgcttgccggtgatggccgtgagctcacagcattcccagggtgatggctggtgcccttgcgaggagccctctgctggttccacactactccctacctaccctcacatggttcatggctatggagacttttgctgtcaataaatagtttggtttgaggattgcaaaaaaaaaaaaaaaaaaaaaaaaaaaaaaaaaa

SEQ ID NO: 340 - DNA, 1113 bp, Mus musculus
tcatttatcgagaaagtttagactatgagccacaggggtccctgcctgcagtccctatagcctccccctgccccagtgcctttctcagctggtctgggaatcagggcagcccattgaggggggctcagacaaccctttcttcctggttctgggagtaaggctttctctgcagccacaaggagaacatgggaaccagaaacttctctttggtcagcccttctgagcacacaggtttagcccatgctccaagaatgctcctgagcattgtataagcccctaggactcttagctcatgtgataatgattgcattactatcctgctttaactgacaaaaccacagagaattttgcttgctttcctactctcttcctctgcccaggcctcctccatacgtatacatacacacatgggcatgtatacacacacatgcacaatagacatgcacacacacatgcacacatgggtatacatatacacacatgcacaatagacatgcatatatacatatacatgcacacattgataggcatacacacatgcacagtagacatgcacacatgggtatacatagacacacatgcacagacatgcatacacacacatgcacacataaatgtgcacacacacatacacaaattgcccaagcctgtgcactcctggtacccatgtcccatcctggcccacctctttgtcagcaggactgactccatcactccctcaggttttgcccaccagcaccccccagctttcccccagcagagctaaacagcccctctgaatagacaacaggaccttctagaaacagctgaacccttggacagcagcaggcagattttgatctgctctcatcaggtacaaaaggtggtatccgtattctcttctgagcatgctcagtaagcatatggacatagaatttaacatctctgtggagtgtgtgttttttacatatttgtatgcagtcgaggagggcctgttgtagaattctctccctgtatcttactatactgttaaagaagctgaattctatgttgccaacagatgcgtgaaatgttcctccaggaaaagccattcaagcctgattatttttctaagtaacttcaattaaattgaag

SEQ ID NO: 341 - DNA, 671 bp, Mus musculus
aataattcaagtgtgtggactgagattaaccagagtggtggggcaattagtggggaaatttctcacagttccatttgcttcaggtatatggcgagtttgttgtatattgaagcccaagattcttcaattgagtatgtctaagaggaaagttgttcaactttataataaattaaagcccattttcatagcatcgtttgaggtcagtgaaatggtcccagtgttagttagtcattggggtaacttgatgtgagaaatgtatttcttgggaaattaaatataagtaaaacattttagattatattttatatgcacaggaagagctagctatcagaggaaatccttttaagacctgttctgaactctgctagttttggctatcgagatgcctcacgggtgaaagcacttgctgctgcatgacccttttgaccccaggtgggctttggagttcatggggaatgggtaaacgtgatggtgcacatctgtattcctagtgctcagctgtgaacagctacccttgatcgtgatgccgcagaaacaacaagagagaccttgtttcagtgacgtggaagaagaatcagtccccagaagttgtatcctgaccttcttttgccatagcatgtgtgagcctgtactcaccccttcccttaataataataaaacaacaactttgg

SEQ ID NO: 342 - DNA, 672 bp, Mus musculus
  modified_base (16)..(17): a, c, g, t, unknown or other
  modified_base (29)..(29): a, c, g, t, unknown or other
  modified_base (33)..(33): a, c, g, t, unknown or other
  modified_base (74)..(74): a, c, g, t, unknown or other
  modified_base (134)..(134): a, c, g, t, unknown or other
  modified_base (331)..(331): a, c, g, t, unknown or other
  modified_base (358)..(358): a, c, g, t, unknown or other
  modified_base (550)..(550): a, c, g, t, unknown or other
  modified_base (667)..(667): a, c, g, t, unknown or other
ccaaattcaaattcgnngtggcaccttgnaagncctcacaccaagccgccgaggccctttttcaccctgcccancacatgctgcccccaggaatccaaaattttcggcctaggaatttctttgtccactcagtncagcactttcaggcccaagaaaaccttggtcgcaccagcacacacagcacggatgagcttcttcccaggacagcagagctgtcaccgccaccttctgacagcaggagcactgagtctttccaaagagcttgttgccatcctgagaataaccaaaggagactctgcaaaagtagagacccaggggacacagagggcantggagggacaaaatccaaggtctctgntttaccaaaccagactgacaaggaggagaagcaagtggagccaagcctgctgcagaccgatgaaactgtgaactcagaacatttaaatcataacgaatcaaactttacattcagccatttagcaggggaggctggctgcaggtcctgcccaaacagtccacagagttgtagaagcatcatgagatcgaagtncgggactgaggactgccagacgccaaaccttgaagccaatgttcctgctgtaccaacacactcagacctgtctggcgagagtctggtaataaaaacactataataaacctagcattnccttc

SEQ ID NO: 343 - DNA, 708 bp, Mus musculus
tttttttttttttttttaaggaacaagcaaggggtattttattgttatatgtgtattctcaaaactaaaactaaaaataaaataaaaaagcccacaaaaatggaacccacaagtagaaagaacaaaaatttgcagcgtctctcggatacacaaggcatcctactctatggaaacacagttgtacaaggacacattgacttacttaatgtcaccttttgcttcccaagtcaaaaaacaaaaaaaggctacagagtaaaatactttacattgttctctgatagaaatttgttgcacgattaaacttcaacttattcaaagagttattgtgtagtaaactgcagaaaatagatgaggcattcaataatctgctcacaattaacaattaagcaacagacacttgcagaagtcagcatatattactaatttgttaagcctcccatgtagaatgagcagatcactgtcattaacagtaacttgatgcttgtcatttaggagatattagaaagtacttttaatgaaaccctgattttcaaaaatatcttcttgggtctgagctgctactctatttatcaattttgacaagtttaataaatatagatgttaacaaactgaatcactggtgcgggagaacaagcatagtctacagcaacagtgtctattgctgccactaggcagcaagttaaactgggacatagtaacctcgtgcga

SEQ ID NO: 344 - DNA, 5220 bp, Mus musculus
cggaactgcttcgactgcaaagcttcaagcgcagcctgggagcggcctggtggccctatcccggcagctccacacagcagaacgccctgggtccctgaaactcgaaacccgggctcagaaccagcggaaaccaaagcgaaatccttgaacttctctgaacaattgcttccgggcgtttgctgagagccgggggacctgaccggagcccaggccgcgtatggcgcgcccctgatgtcacacggacgccagcgaggccagcgctccggctgcagcatggaccgcgcggggcgcctgggtgcgggcctgcggggactctgcgtggctgcactcgtgctcgtgtgcgccggacacgggggccgccgcgaggatgggggaccagcttgctacggaggattcgacctctacttcatcctggacaagtcaggaagtgtgctgcaccactggaatgaaatctactacttcgtggagcagttggctcatagattcatcagcccacagctaaggatgtccttcattgtcttctctactcgagggacaactttaatgaaactaactgaggacagggaacagatccgacaaggcctagaagagctccagaaagttctgccaggaggagacacttacatgcacgaaggattcgagagggccagtgagcagatttactatgagaacagtcaaggatacaggacggcgagcgtcatcatcgcgttgacggatggggagctgcacgaggacctcttcttctactcagagagggaggctaaccgatcccgagaccttggtgcgattgtttactgcgttggcgtgaaggatttcaatgaaactcagttggctcggattgcagacagtaaggaccacgtgtttcctgtgaacgacggcttccaggctctccaaggcattatccactcaattttaaagaaatcctgcatcgaaattctggcggctgaaccatccaccatctgcgcgggagagtcctttcaagtggtcgtaagaggaaatggcttccgacatgcccgcaatgtggacagggtcctctgcagcttcaaaatcaatgactcagtcacgctcaatgagaagccctttgctgtggaagacacttatttgctgtgcccagcaccaatcttgaaagaagttggcatgaaagctgcactgcaggtcagcatgaacgacggcctgtccttcatctccagttctgtcatcatcaccaccacacactgttcagacggctccatcctggcgattgctctgctggtcctcttcctgctgctggccctggcgctgctctggtggttctggcccctctgctgcacagtgatcatcaaggaggtccctccaccccctgttgaggagagtgaggaagaagacgatgatggtttgccaaagaagaaatggcccacagtagatgcctcttattatggtggacgcggtgtgggaggcattaaaagaatggaggtccgctggggagaaaagggctccacagaagaaggggcgaagttagaaaaggcaaagaatgcacgagtcaagatgccagagcaagaatatgagttcccagaaccccgaaacctcaacaacaacatgcgccggccttcctcgcctcggaagtggtactcgcccatcaagggaaaactcgatgccttgtgggttctgctgagaaaaggatatgaccgagtgtctgtgatgaggccacagccaggagacacgggacgctgtatcaacttcaccagagtgaagaacagtcagccagccaagtatcccctgaacaacacctaccaccccagctccccacctcccgctcctatctacacacccccaccccctgctccccactgccctcccccagcccccagtgcccccactcctcccattccttccccaccatccactctcccccctcctcctcaggccccaccccctaacagggcacctcccccctcccgacctcctccaaggccttctgtctagaacccaaagtccgagctctgggctgcctgagcaactccagcaggaggcttctctgctgaaagaaagatctgcccagcctatgtggtgagtggcggctgatgtttgcacgatttaaaagcaagtcgtgatgggcagaacaaaatgggcattttgaactgcctgaagacagacaatgagacaataacagtcacattatagcctgtgacccctcacctctagaggaaggttcccgagatggccacattgccacagtgctctcagccagattatgtcccatgaagaccaggaagaaagtgacttccaagaatggaatgcagcattggataagaaacacctggctgagattctgacctcactgatttgactcttgattcttggactgggagccaggccatctccacccctggtaccacccagcaactctgaaaatgtgcagtgtccctagtatgcatcgaataggtatccaactgggatctgcaggttgccttataaagagcatatgctctattctctttcccgaacttcctggtttcccagtgatgagggaaggggaaaggtgttgccatgcttagaagttagaggacgtcagtgctcagcactgatggagaagcgttgatgggagtgtccagctcttacatctagaaatggctggcttcagcaggcacagttcctaaaccaacaagccttgtcattgtcaaaggcaacctactaatgattcaccttaaacatcaaggttgactgtggcataggtcagagctgatcacacagaaccttccccatgaaatcgcaaggttcctcatcttcaaatacccaggaccccagagatttctaaatccagctaagagacagtagtcctgacttggcaagaaaaccattcccagttgttttactctgaaacaggccgttgtatgtatggtatatctctccttggcctttcaacctgctcacaagtattaccagttatgaagcaaggagaaatacatccagtgtgtaatagaaaagctctgcccacaatccccatgtcactcctctacattattctgaagctgcttggtcagtgagccctttaacctcatgtagactctggacactgtcacccaatcatgaaaacagaggtcattgtcaaaggcagtgtatagcctgtacaaaaatgatgcttccttcctcagtttccacaggccccaaaattcctgtcttaggctcctaaacctctaaactttttcctggaacaaaagatataaaacgggcataagtttttatgttttgggctgtgatctccaaagatccttcaagaactcaagttagcctcattcttccagcttgtttagaacagaggcatccaggtgtcatgcactccatagacaccaatccttgttcccaaggcagacattattaatcaatctcagcactagttctcaatttaatccaattatatttttccacagtacttcacatctcttatgacctgttggtcatcagttagaattgagagagataaacactgtttgtaatccctaccttagaaagaaaagcagaggagaatgggggaaccaccagcataaaagttattatctggggaaaatcgacctgaaagaacgcccaagtccaagacctatggtgctgacaccaaagtaacactttcccaagtgtaccccagaccccactcttctccctgtggccaccactccctgcttttcaggagttgtgaaaaagatctccttcacccttactgtgcccccatattagaacaaggcttgtttagtgtagtccttgttaaacaggtgccagaatgtctcagccacctgagatgacattgctgggccccagaaaaccattccaaggagaatgggctccccaggctcagagcatgcaactatgagcccatggcaactgttttgactgctggcagtacaaaacgggccaccccacattacagctgcaggatttgtgcagccataagaaagtatgaaccaagatgctggtgttgctgttcaacaagcatgggcttcggggaaggcagcagactccgagagcaggccttgtgcagtgtcccaaggggctgtggtgaagtgtctgaggaaaaatgaatgctgatacatggtgattctgagaagaatttgcaaggtttgaccttagaatttatggaatgtcttccctggtcattcagaattatggctagaagtttctagaaaccgtcaaggttaatacctttcagagtaggtgattacaggcaggaagagctttgatgtggtttacaaagcccatcagttctgtgtcattccctgtaagcaacaggagatggtggttgtgattagcaaactgcatgtgttatttgtttgactccttgttattgtccttacggaggattttttttatataagccaaattttgttgtatatattcatattccacgtgacagatggaagcacgtcctatcagtgtgaataaaaagaacagttgtagtaaattattaaagccagtgatttcatggcaggttaccctaccaagctgtgcttgttgatctcccatgaccatactgcttttacaatgtacaaatagttcctaggtgacgagaccctcctttacataatgccgatgacagccttgctgggaactgcggtccttctgctgtgacagccagctcgaaaacaggtcctgcctggagcttgccacacactttagggagacataagagctgtctttccccagcgtcagggacaaagctaccataaagaagtggaaaagtcttggctctccagcctgggacagaggtctctctggaaccccaaggaagagcagaaatgatccttgcctgccactgcacacaatgtgatggtggaaaatccatcaaggaataattgtgagataatgaccgacagttcaggcgcaaagggaattcatgctgtgtaaagtgggtggaattcgtttgcaagctatgcaaagcctgatcttactcaccaggaggatggaaagggtttttttagttatctgagctcagctgagttatcacgcttggagaaccgatttaaaggaattagaatatgatttctgaatacacataacattaaactcttctctttttctatggtaatttagttatggacgttcagcgtctctgagttattgttataaaagacttgtcatcaccgcactgtgctgtaggagactgggctgaacctgtacaatggtataccctggaagttgcttttttaaaaaaaaataataataaacacctaaaatcaaaaaaaaaaaaaaaaa

SEQ ID NO: 345 - DNA, 1004 bp, Mus musculus
agagactcagcagggcaccgccaaggccaggctcccagtcaggttgctcttgctcgaggggagcgctgacctgccgaccacagatggagtgggctcagcacagtggtgagaccagaaacgagttgagagcagctctctgcccttcaaaacaaaagagccggcagaagagtgaagaggagagcagagtctcagagaccatatgtgtcatgctgtggaagcctgggagcttaatcaaagcacctacaggtcctgggatccgactgtcttttccagatttcatcccctggctggataccgaagaaagggctgcagggctgcggtttaaagcatgaatggaaatttcgagccttctctcccactaccaccccccatgcattgctccagcccagtctgaacaccacgagtttttaggatcgaactgaactgaatttctgggatcaatgttttccccataaaatctgaacttctcttggcccagctgtttggaaaaaaattgggaagagtgctttgaggctcccaggagatgtacagacttcttcaacgcagaagtgtctctaccttcaaactggggacacatacctatacatatcattgtatatatcactggggcatccaaactacacatgttctccactccatgactctgtatactatgaaggctaaaggtgagactttaatggtctttttgttgttgtttgtttttgtttgtttgtttgttttcgagacaaggtttctctgtgtagtcctggctgttcaggaactctctctgtagaccaggctggtctcgaacccagaaatctgcctgcttttgcctccccagtgctgggtttaatggtcttaatggtaccgaattattacttgaataagttctagattaaaaaaaaaacccaaacccaaacaaacaaaccaagaccccacaacaaaactcctcacatgttctgcttcacatcacatctcatctggaagaaataaatatggcatgttgcttttttccacttttgatg

SEQ ID NO: 346 - DNA, 640 bp, Mus musculus
tggttttgatgcgcacctttaatctcagcagttggaggcagagacaggcagcttggatttacaggccagcctggtctacagagggaacgtctggaatatacagagaaatctagtctcaaatgaaagagagagagagagcgcgcgcgtgcacgagcgagccatgggaaagccagtgtcaaggtctgcgttctgccctctctctcagctatcttgaagtaaagaagaccatcacaccaggttggcactttgaccgttcttggtagcattaggcagtaagtgatcctagtccccagcaggtggacatgcaggcctagcttgactcggaagtgaagatagccaggccctgctgccctgaaggcacaactgtcagggcctccacctccccgcccccacgagtgggcttctggaagtggatctcaaggatgtcatgcagttcctgtgcatccatgacatcaggaatatttgtcaccagcactgaatgaggggcttgctggaatttgatctcagctgtctggatctcaccactcacatagggagagaccctcaggaggacctgctgcctgtccagtgggactctgaactggccaatctggcataagtagctggccacttcttcatcagcgaacactaacatgacggg

SEQ ID NO: 347 - DNA, 1029 bp, Mus musculus
  modified_base (59)..(59): a, c, g, t, unknown or other
agggtgaaataaattcatcctacagttctgttagccatttctatgttttcttactgaancaaacctaagtcagagcagctttgactcttccctccaaagcgaccaaaggtctctcatagaccttagaagaggaagcagtgggggagacttacagcttgcaaaccgaataaataaatcccagaaaatgggagatccacggctgactaacacaggaacacctccttccctcccccaacccggtaagaaggaatcagaacccacttgctatcctggtgttactagtctgctttggctgccacctgtgctctggccagtggctctctgtcctttggctcagggttttgccaatggctgctgcattgtcctgcacgccacagctcgtataagtgcacctgacacaccagcgtcatcacagaactccacagaacagatgggaattctctgtttaatttcccatcttatctagcacatactttgctgaatataattaccgtaggcagtagaaggccactatagttagggaaatgggtacagtacgtggggaaccctaaaagtaatgcacgagagtagttaccaaggactcggggtgcgggggggagggattcttctgatcaaatatcactggtcctgagtgggtgtggtggttcagccttagtcccagcactcaggaggcagaggcagaggggcagagagagaggcagagagagaggcagagagacagaggcagagacaggtagatatccttgagtacagcctggtctacagatcaagttccaggaccgccagggctacacaaagaaaccctgtattgaagaagaagaaaaaaattccactggtcctgaaacaaaaccatggatatcattgtgttcatacagagagcaagtctgggtgggcccaagggtttcagctgcatttgtatgtatggatctaaacaaatgtatatttttcaagatgattttgcagaagttctattttaaatgttgatcaataaattcatattcatttaataaatgaaaataaatggtttct

SEQ ID NO: 348 - DNA, 667 bp, Mus musculus
aaacctggggttcccacacgccagattgaattagcctttcaaagtggtgtctttagttcataattcatagggaccaaagctgtttttaatatgataattgattttctaacaaaggtttactctacattctaacaccagttttttgttttttttttttacattctagatattccaaatcaattgctcgtggctctaagttgtaaaatgttttcacgttatgaatgtaattatttccttaatgtatttttaaaaaaaaactaaaatcatatttaaaataatcttggaaagacacaggcaaagaaaagagaaagtttgttttttggggtttttttgtttgtttgtttgttttagttaactatgttggtagcccatttgaaatgactgtaaatatatcttgattgtgtagctcaatgtatttaattcagaaagtaaaatttttttttatgtaaagagacttgcaatgaaagatcctagttttcagtccacgtcccccatctcatagtcccttcacccgacctttttgctctacaaactgatttttttctactgttgtttaactgtgtacccattgactggcgcccattggcggaacttgtttgtgtattaataaaactgtgctgtgtggcccagcctcatgtcctcctgacagtggctcatggcacaggag

SEQ ID NO: 349 - DNA, 671 bp, Mus musculus
gcttttgcccatcagttttttgtttgtttgcttgtttttgttttttccttttctatttgtttcacattaaagactcagctggcttggtttgcaaagtcaatggaataaggtttggagccagtcatggcttttgctccatcttcagctcattctctgtcttatttaaccgcgaatggctgatgctgaggctctgtcgttactaagacttcagtgccttatctctcagaatttctcagctcccagtataatgtttggcgtgttttaatgcagttttccattggaaagagtttccaaagtaatttggatattcagtggtattggtttctaacaacacgtctaaagaattggaatttccttttcagacaaaggggactgatccctgcttgcaaagcacaggcaggaaatccgatgctcaaaggcagggaacagtgagaaaattgctcctgacagcgcagctgcagccttcatggtaagcttgcatggctcagggactccaggaatgagaacgctcagaattatatagcaggagagacatgttgcttggataccatcctccaagaaggataaagtgtaatcagagtaaggggcttaaaataaaaatcttacaatgagataagagttagtataagaagcatccaaatatgccggttctctcaaatggacaggcacct

SEQ ID NO: 350 - DNA, 286 bp, Mus musculus
ttttttaattttttgtgtgttttgtctttttgcctcctctttatttgaaatggctgtgactggtcttcttcagcaaagattaagtcttaaaagtgaaaccgtgaagaggtttagggtttgggtattagtcaaagtagaaatgacataggattggtcatgaaaacggcggctttaatgtaaacactacattccatctttttaaatttttttgtttttttttccatcttgtggtatttaaaaatttttttttgttctttttgtctgcagcacaaacatccccacatga

SEQ ID NO: 351 - DNA, 767 bp, Mus musculus
atcttgtgggccatgttaagttcatttctcaagctttgagtctttcaaccagtttgtgtaattgaagcataaacttaaatccattaccacttttattttgctctaattttttagaaactaattacacttaaaagcaaatgaaaatcttgcaaaaatgatcaagtgaaaacattgcataaagaatacatcacttttacaaagatgaggaacagtcagcattttgacacgtgtctccttcctttcctgatactactcatttgtattcagaaaacacagtcatccaaagtcatccatgaacgaatggttagaaattaggaaaattcagccgtgatgtccacagttatcatggctaaatgcattgatttttttttccctattttgaagccatgtgtaagctctccacctaaatgttaagataagctggactatatagagaagtattgttcattaaccaatttttttcttgttagtcaacctccaagaactatttcggagaagtccccttccctttgtgtccctttaaaggaaaatgcccctttcaagatgcacagacatatataacagcaaactaagagagctatcatcgaattaagtcttcactgagtttcaacatgaacacaatgttgcagggtttgtctacggcagtgccactgttggaggaaggatgaaacccttgaggtaccctcggaagcacagacacagcgcatcacagactctaaagatggatcagcgcttcagcattttggccagtgcttttctgagagcaa

SEQ ID NO: 352 - DNA, 1025 bp, Mus musculus
tgaagatggagctcagaggcagagcacttgtctagcataaacaaccctgggttaatccgagctccaacagggaaacagtctgcagactgagagaaccgagcattctatcagaaccccgcagctctggattctaggtccagcagcaaccagagagaccatgcaggtcatccttgctgtgatagtctggatggcttcgtctgtgtctagttcttcatttacagcaagcactttgccagatataacaaacgaggacttcattaaagaatgtgttcaagttcacaaccagcttcggtcaaaagtgagtccaccagcccggaatatgctgtacatgtcttgggacccaaaactagcccaaattgcaaaagcatggacaaaatcttgtgaatttaaacacaacccacagctgcattcacggatacacccaaatttcaccgccctgggagagaatatctggcttggctctctatccatcttttcagtatcctcagccatctctgcctggtatgaagaaattaagcactatgacttcagcactaggaaatgtagacatgtctgtggccattatactcaggttgtttgggcagacagttacaaacttggctgtgcagtgcaactttgccctaatggagcaaattttatatgcgactatggaccagcaggaaattacccaacgtggccatataagcaaggagccacgtgcagtgattgcccaaaagatgacaagtgtctcaacagtctctgcattaacccacgacgagaccaggtctcacgttactactctgtcgattatccagactggcctatatacctgcgtaacagatacacatctctctttctcattgctaagtcggttctcctattactgtctgttataattaccatctgggtaaagcacaaatatcctaacttggttcttttggactaaagctgtggttgggggacaactgaatcacatgcggctatttaaaaacttttcaataaaatctcagtcaaaagaaaaaaaaaaaaaaaaaaaaaaaaaaaaa

SEQ ID NO: 353 - DNA, 642 bp, Mus musculus
ggataaatgggtcccccctaccacccaagaaagtatttatttcagatagtcctggattcaaagtcaatgggtttaagaaaatgccttgatctccattattcccatgacccaaaagagttaccaagaaagaaactgataaaagtcacacataaaaccaacatttaattaagaagttaaagactatacctatagttgcaaaaccaaaagtgctcaaagcatgactataaatgatgaggctgaaaataggaaaagcccagttggggatggcttttcagaataatacttttagtgtctgatacaaaaagcacttagtaactgaaggtattttcatataaagtcacatgaacccagttcccagaaattttaagtgatggcagatctgtttggaaatgtttgctttcactgatacagagagcagtctttatgttttgaagactttcaggaagtcgttaataggagtggactgtactgaatgctgttggatctttcaaggtttccaccatggctttctttttttctccagaatactgtgattaagataactgagcacttctctttacattgactgtataaatatgttgattttgtatttaaaagtatttgttaaaatatagacatccagaagtaaagtctttataatct

SEQ ID NO: 354 - DNA, 427 bp, Mus musculus
ttttttttttgtttccttggagatatttattataaatcctccaaacattgtcaacagagaaagacataattcctattttctctaggatcttttttttttttttttgtatctgatgaaatcatggaaccctccactcataatcatgtctacagagctctaggtaccttttgacaggtggaataaagtctcaaatctttagaaaggtagactgtaatcacatacccttaatctgtaaaacacagagttcatctgtggattccacattgtaactgtctatctctccagttcccttttttctgaggtcacctcttatgtcaataagcactcctgtcgaactactcagaggggtgttgcagtggcagaactggactgcccaggacttcccagccagggccctaaaacaaaacaaaaaaacaaacaaacaaca

SEQ ID NO: 355 - DNA, 3510 bp, Mus musculus
agtttcatgcaggctcttggggaagctggtgctgctgctgctgtgtgattaccgcggacagaccttgggaccgaggccggcgctggcagctggagatggcggacacaccgtcagtgtatgaaaccagatttgaggcggccgtgaaggtgatccagagtttgccgaaaaatggatcattccaaccaacaaatgaaatgatgcttaagttctatagcttctacaaacaggcaactgaaggaccctgtaaactttcacggcctggattctgggatcctattggaagatataaatgggatgcttggagttcactgggtgatatgactaaagaagaagccatgattgcatatgttgaagaaatgaaaaagattattgaaaccatgcccatgactgagaaagtggaagagttgctgcatgttataggtccattttacgagattgtagaagacaaaaagagcagcaagagttctgacttgacctcagatcttggtaatgttctgacctcttcaaatgccaaagctgttaatggtaaagcagagagcagtgatagtggggctgagtctgaagaagaagaggcccaagaagagttaaaaggagcagaacagagcggcagtgatgataagaaaacgctgaagaaatcagcagataagaatttggaaatcattgttaccaatggctataaaggtagctttgttcaggatatacagagtgacattcatactgattcttcccggagcaccagaagcagtgaagatgaaaagcctggagatgagagctctcagcagacaggacacaccattgtctgtgctcaccaagatagaaatgaagatcccagtgaagatgcttcaggaatacaccatttaacaagtgattcagatagtgaagtgtactgtgactctatggagcaatttggacaagaagagtattatttaggtggtgatcctactcagcacttggaaagttctggtttttgtgaagatgctcagcaatctcctggaaatggcagcattgggaaaatgtggatggtagcagtcaaaggaaaaggcgaagtgaaacacggaggagaagatggcagaagtagcagtggagcaccgcaccgtgagacgagaggtggagagagcgaggacttctccagtgtcaggagagggagagtagggaatagaataccacatttgagcgaaggacccaagggtcggcaagtaggaagtggaggtgatggagaacgctggggctcagaccgggggtccagaggcagcctcaatgagcagatcgctcttgtgctcattagattgcaggaggacatgcagaatgtccttcagagacttcataaactggaaacactaactgcttcgcaggcgaaattatctttgcagacaagtaatcagccctcctcacagagaccagcttggtggccctttgagatgtcccctggtgcattagcttttgctattatatggccttttattgctcagtggttggcacatttgtattatcaaagaaggagaagaaaactaaattgaagaaatggctttttactcaagaagactgctgggcctggacgacctaagagacggactggaaatgaagtggaattcagaagaaaatctcagttttgatgattacgttgcttttttgtccagtagtttggtttatatacataaatattctttgcactacacaaatggtaacattttaaagactaatattgctgatacttgaaaaatcaatctcaactagattttaagtagcatccatagacttactctttttgagcttgaaggactaaattattaattattgttcagtaatgatcacctaatttttcccataagaattataagctgcatttctaaggcatagctccaattatgagataaaatttatactttttacttttctaaattaaacacaagaaagaatgcaaaaacaaaagtgattttttaaaaatgaggttaaatcgattttgcatcagtcactgaactgtcagctacgtggcaggaaccggacggaagaatcctctccaggagactgggctttagttagtggcttgattccccggcttgctcaagggaactcagaaaatcatcgtccttgtactgcgcttctgtttacaaacgattcactgaacagacttaacttgatgatggaaatgatgaaaaacaggcctaatgtaggtgtaaaagtgtattcaaactctagacacggctaatcagattttaattcaatcatacacacataatcctttgtaatcatttttcttttaagtgaggatatctactgtctgcttcatagggtgctttgcaataaaatgaaaacgtatttatactgtttttactaaggtaacaaaagcatgataatccttttttttgcaagtgtaaacgacagtctggactcttaacttcttagtgcctcagttttcctttggggtatacttcacaaggtatcagaagtactttcagtctacaggtctctatgtccacataactaaggaatgcccaactaatggaaacttaagttccttctagccattaaaacagagagaagatcaatttagatcccggaacactgtatttgaaaaatagtcttcctgtgtactttctcaaacctgcgctcagtaatatactttattctttgaagatttaatttaaaaacttcatagaaaatccttttttgcttttccttttgagacagagttttggtagctcctaccagcctccaattctctatgtagctgaagatgaccttgactacctgagtttcctgtctctatatcttttcagcttctgggaccacaggcctgtaccaccatggccagctttagagagtagaacattttaatttgttcttgatttgtatgatgttgggggcgttagcattacgtgttgaatattttgagtaagaagaaaagaatccatcttcagaatatagggttgttctttgggaaaaagagtataagaacataatttctttgtcctagactttacaaatttttcaaaactgtaactttattttaaacttgtgtatcacaacttggttgatatgcctaaaatgatctactggcttttgcttatgattaaaaaacctcaaatctatcttctacattttaaaaggaagaaaaaaaagcaaataactgaattattatagaaaactttagacctgtgacatttttttgttttaaattacaaaagaggttggtatgataaagtgatggcttttttcttatataaatagaatgcaaatcaaagatataaccagtgtgattgattgcaagtagtcaagtgtaactaactcctaagggcaaccatttgtatcttatatatcagaattactttatagtttgaaagcactttgcacacatttcctgtatataaaggatgtaattacaggatatagtggtaatgcattaaaacatgaacctcattttagaaatcgacagctatggtatttttttaatgatcagcttttctgtttattgtaaaactaagttaaaaaataaaaggttaatgagaaatg

SEQ ID NO: 356 - DNA, 611 bp, Mus musculus
atgagctgacgctacttggtgagatctctccttgtaggatgctatgaagtcaactcgcttggagaccgaaggtttagggtatcccaaactctgatgttataagtgggccagaatgaaccatgtgtgagatgtccttgatggtgtatttgctaagagggaattgtggtatttatgcatggttcattgtctgccaggaaatacataaagatgaaagaaggcactcttgtacatacaggtttcttgtgaagtagaccacagagctgaacatagagatacactgattattttttcatactgccgcgttttttaaaaatgctaggatgagctctactgagagtaggttatatactgtgaccacatgcaaagtgagtcttcaactgtatggcgcctgtgctcacttacatcagagctattcatgtcactgctgcctttagagactatgtcttcactgaaatacgtgaccagggttgtacgtgccttcttagcatatgaagtggtgattttaagacagtaagagtgcctttctgctgtatgcacacagcataactgtttcagtgtcccgcgtggtacctgttcttattcaataaatctctcaaaagacagaaaaaaag

SEQ ID NO: 357 - DNA, 1766 bp, Mus musculus
gcctcaggagactgtctcatgagcagggaagtgttgtggccggctggactgtgcctgctttagagtagacagagagggacgtgggcatgttttatttggagggatgtttattccctgagattacagaagtacccagaagtgtctgggatccctgtcacatctgtgtcatgttgttatttgaagcatcagactttattactatgctaggtcctcactactgccccctgcaggctggggaaagggaactttttgtctacgctaagtccctggcttcctcttaatcggttggtcttgctaattgaagctcagaaaaatatagatggtctctcccgaccctgtttgtggtgtgtgctggcctatcaggatctggttagcctttggaatttttgttgatgaaatctcaatacataaggcgtcaacagggggctggagagatggctcaggagttaagagccctgactgctcttccacaggtcctgagttcaattcccagcaaccacatggtggttcccaaccatctgtaatgggatctgatgccctcttctggtgtgtctgaagacaacagtagtgtactcacgtatatgaaataaataaatcttaaaaaaaaaaataaggtgttaacatgagaagaggcgcttcaagctcttctaagccttgatggtgtctccctttaggcaaagatctgaaatatgactacagttgtgctgttgatgggttctgctttagaaattgtatttttttttaaaaaaatgttttaattttgtccatcctagagataataacgaaagagaaatgtctgcatgtgtgcacacacacacatcttagatacacaaaaagaaatgttcagattcctttgagaatttcaaatgaaaaataatctttctgtatgtggtgtctaacatctacaaggtgggggctggagaagtggcttggtgctcaaaggcacttgctgctcttgcagaaggccaaaagatgtgatttagttcctagcccatcaggcagctcacagccacatgactataactctagacccagagaatctgatgttcttctcctctgagggcatctgaatgcatatagtgtgtgtgcatgaacacagcactggacagtacactctggtgtacacacttgcgcacacatatacacacacaataattttttaaactccataaagttattaacatgtcagcaggcagagcattgcagtttatttaactgatggccaggttcttgttagaacaccaagcacacacttgagattatttattgatcgaggcaaagtaattagtcatgtttgggtttgctttttttgttgataagattaacaatgtgtgctttgtaaatgcctttttccttatcttctatgtctctgtcaaggacagaagttgtcagtttaatacacgagctcttgtgttgaaagtgtccaggccgtagaacttcattgctactgactttacacagtttacaagtttctctttggacatatctggtattattacagaaatctcccagattatacacataaacattttatggacattttttgggcatttaagccatcaggcctattgcaagagtgcctcctgtagcagttttaaccaaatttcattcccctggtaccgtggagctttattttgctattgaacgccaagctgaatgtgagtgacagggaacaatcccagctctgggctctgcagaaactcacaaactaaactcctttctggttgtctgttttcaaaatagatacaataaacattgtttatgcc

SEQ ID NO: 358 - DNA, 1686 bp, Mus musculus
ggttggcaccagttcgctcacccttcgagaggcagagcgctcttgtccgcaatcttcgctgaccgcgctagctgcggcttctgtgcgccttcattcggaccttagcagccagcgtcctggcgtctgaccccgccatgcctagcctctgggatcgtttctcgtcctcctcttcctcttcgtcctcgtctcgaactccggccgctgatcggccgccgcgctccgcctgggggtctgcagccagagaagagggccttgaccgctgcgcgagcctggagagctcggactgcgagtccctggacagcagcaacagtggcttcgggccggaggaagactcctcatacctggatggggtgtccctgcccgactttgagctgctcagtgaccccgaggatgagcacctgtgtgccaacctgatgcagctgctgcaggagagcctgtcccaggcgcgattgggctcgcggcgccctgcgcgtttgctcatgccgagccagctggtgagccaggtgggcaaggaactcctgcgcctggcatacagtgagccgtgcggcctgcggggggcactgctggacgtgtgtgtggagcaaggcaagagctgccatagcgtggctcagctggccctcgaccccagcctggtgcccacctttcagttgaccctggtgctgcgtctggactctcgcctctggcccaagatccaggggctgttaagttctgccaactcttccttggtccctggttacagccagtccctgacgctaagtaccggcttcagagtcatcaagaagaaactctacagctccgagcagctgctcattgaagagtgttgaactacatcctggggtggggtgcggggagggtttctcactgccccccaaagtgaagacaaggaatttctgtggtggagacccgcaggcaaggactgaaggactgtcccctgtgttagaaaactgacgatagccacctgaggggcgcagggccaggtgggggaaggaagtgttctccaggaagtctctaggttgtatgcaggtggctccctgttggggcacacgcccctcagtactgtagcatgaaacaaaggcttaggagtcacacaggcttctggctggatgtgtatgtagcatgtaccttatttttttttattactgacaagttacaacagcagttgtgggccagagccagaagggcagctggtctgcactggcctctgccccggctgggggttgggggctgggggggaggcagggggaggtggccgacagtttgtgtatcttctggtctgaaaggacctagtgtgttttgtcatttgttttgtatcttggttttggggggtggggatcggcgcttcactactgacctgttcgaggcagctatcttacagactgcatgaatgtaagagtaggaatggggtgggtgttaggatcattcgggatcttcgacacttgaaacaaaattacacctgggagctgcagccagcccatcccggtgcccatgtactggaggattcaactgtgaggagaggggctggggtgggggtggggggctggaaccctcttttcccagaggagtgccacctgggtcttccatctagaacctgtttacatgaagttactcgcggttcatgaatacacttgatgttcaagtattaagacctatgcaatatttttacttttctaataaacatgtttgttg

SEQ ID NO: 359 - DNA, 556 bp, Mus musculus
tcagtcacctgttcccactgatggtcgtacccccaacttaaacacaaccaaaatcccttgttaatatccaccaaatgcaaagtccctcgtggcctcttacttctagggtcaggaagacacttaaaattccaggtaagactccctagccaccatttaaacacattagccattgtcctggggggggggggggtcttcctgagctgcatcgtgcctgtgtactgctcagaggccctgctgttataggttctgactcatgggcccgccttgctgctttggggcaacttgaggctagcccagggccctttctctgcttctgattcctttctgcccaatgcctcccaagagctacaccagcagttactgggtaccgtatgacccttggccttgacatccctccctaggctggagtctggggttggggccccatttgtcctctgttttggctgaagatggggtgaagatttggctgagtggcctatcctgtcacatcaaacagctatcatttactcctacttgggaagttttcatgtgacaataaaagatacatctgactttt

SEQ ID NO: 360 - DNA, 931 bp, Mus musculus
ctgggacagaagctgcccaggaggccccaaccaggcccgggggagcagttcaccatcttccaattctggagttatgtagaagccttggacagcccctccatggatgcctatgtgacagagactgcagaggaggtgttactagtacagaacctgaactctgatgaccaggccgttgtgctgaaagccctaaggttagcaccggaggggcgcctgcgaaaggatgggcttcgggctcttagctccctgctggtccacggcaacaacaaagtcatggctgctgtcagcactcagcttcggagcctgtcacttggtcctgtcttccgggaaagggctctcttgtgcttcctggaccagctggaagatggggacgtgcagactcgagtggccggatgcctggctttgggctgtatcaaggctcctgagggcattgagcccctggtgtacttgtgccaaacagacacagaagctgtgagggaagccgcccggcagagcctgcagcagtgcggggaggaaggacagtctgctcatcgacagctagaggagtccctggatgctctgccctgcatctttgggcccagcagcatggccagcacagcattctgaactcttaattgccggctcccagtgtcccttcccttgttttcagggctcatcaggcactggcagggagggtgaaggctggttccagtcacctctccccacaaattcctatcaatgaaaatctaatatattcttttgttaccactggggttggcagaatgcctgaaatgaagtgcctcccagccgcggttctgcacagtctttgccacacacagtgtcggaggcctggccatttggtcagcttgccttgcctcatcacatcccttgggtttgtattttatttacagagttttacagaaaataaaagaaaaaaaagcaaaaaaaaaaaaaa

SEQ ID NO: 361 - DNA, 1501 bp, Mus musculus
ggcttcttcagcatttttactctctttctcctataggattcataccacctaagttgggtccacctaagcttagccacagccataaacttgtcggagataccaacatccataactcagagccacctctcctgggctttaaggatttgtgctctagagatatgggctttagttgtggtaccgctttctcaggtagctttgctagttcaaaggattttgatccaggtaaattttcccaaggccccaacaacatcagcttctctcccaaagcccctgagatgggcgctcttcaccagtcacctttttgcagtcctcctaagccaccttctgcccctcctcttgtcaccaacgtactttgctctgaggctcctcagagctattttcttaatttgcaaagtgccgcagtgcatcagagccctaataacagagtgtcagagatcatcatggagtcagttgagtcatctctcccatcagattactcttccagagatgcgtcatcatacttggctctagaaggggcagaagactccttgctgggtggaagttcttttgaaaccgatacagatgaagcagcagcatttatagccaatgatcttttaacaagtattgagacttcctcagatgaggaatgtgccttctgtgatgaagaccaggagagtcctgtgccgtgggcttcactctttgctctacagactgagaatggtttttggaagctgacaccagaactaggacttatattaaaccttaatgtaaatgctctgctcacttctcttgaagaaaagggcattcgatctctaggtacaaaagggcgagagcgtctcctggatctgattgccactttgctcgtactgcagtttctttataccaagttggaacaagaaggaatggttgccaagtctctgataaagatggatgacgccttcatttctaggaatattccatgggcttttgagaacataaagaaaacaagagaatgggccagaaagacagaaggacagtatccatctatctgccaacggcttgagctgggtaaagactgggagtcagccacaaagcaactactgggaattcagccccaagccaacacttctcttcactgaattctatactacagccaaggctgaagccaatgaaatcgcattttaaaactttcttttatttcttttgttattgttttgtttttgtttttgtttttttcaagacagggtttctctgtgtagtcctggctatcctggaactcactctgtagagcaggctggtctcacactcaagggatctgcctgcctctgcattccaagtgctgagattaaaggcatccaccactgctctgatgcctttctcatatttctatgtagaaaataatcaaatagtaaaatgtaccaataatgacgtgtaatacgtgttaaatgtagctacagcccctttaaaataaaattaatggaaataattgattaatcatttaacaacaataaaagctgtaagaactaaaaaaaaaaaaaaaaaa

SEQ ID NO: 362 - DNA, 549 bp, Mus musculus
caggggccacacggggtccctcctaccctccactgccctcctctgaggaagtcatgagagaaggggtaaaaaatggtctggggaatttaatttcagaatagatcaaaattctaccttttggaagaattgagattcttatgtgggcttttttttgttgtcattttttgtttttaataagggtaaagagaatagcttccagaatttagcaacaaatagttgtggcaaagcagaaacttaaaaatatgtatttgagatggaaggtctcgatatcatgagtttcaggtgttggaagtttgggatttcgcaattttgtcatttgaaggtgatcaagtcttgtcagtttgtgccctctttccccatgtgacctgggaagaagggagaaagtgggaagccactggttctgtgccacagcacgcaagatttagaattttacagactctagctctatatgtagtgaggacccagatttagagaatctgaccactatttatctccagatttgtgtgtgtttccaattctgtaggccaataatcaacagacaaatggaag

SEQ ID NO: 363 - DNA, 549 bp, Mus musculus; identical to SEQ ID NO: 362

SEQ ID NO: 364 - DNA, 1532 bp, Mus musculus
agtcaggtggacggtcccagctatgctgtggcctgtcactgttcatctgacctgcagcagggccactccaatgggtttcccagcccggcttccatgggcgctaaaagcagagtgtgcttcttggttgggaagctggctagcgggcttccatgcaggggcctgggtggtgccgcattgattcccatgtgggaatcagccctccagtggagcagctgtggcatccagtttgagacagtagctgttgtgagatcacggcttctcctcttgttgctcctgagcacaggttgggagaagatacagggtgtgctggagtatccttgtagaatagcagcctttattccttccccactttacctgtctctggaaagggcagcagttgcatggggaaattaacatttggatttagctctgatcatagctcagaaccttctggaatagcgggttagaggacagaatttttagagcagggctgtttggtcaagaggtggacttaaagccttccttaggcttcacttagccaaccaaggcactcacaaatgtcccctcacgtctcttgtcagtccaggttgacccccgtctttggactcgtttgtctggttctatttaatacctcaaagtcagtgtggctctgggccacgttggggcaagagcgtggggggtgtgctgttgacacggcattcagcaaggtttggttctgggatgccgatggtcaccccctcccccgtctcttccctctgtcgtctgcctgtgatacacaccgatggcaataactttttttcggctccttgcagaagtgggagagggctgcagccaaccctgcaaccagagagcttctctctctcttgcttccactctgctctgttttggctacagagatctgttcatcccactcctgttcccccgcagcgtttctcatccctcgcctccctttatggacaggtgtctggccttttaaattcccgtgttgtggtgtcttctcatccctaccccagttatctgtcttggtcttgccgtgtgatgggatgtgcttgtaaatccagtatcaaatcagctttgtgtatatgtgtgtctctggggtggcttcttccttttgctggtcactagactgtgttgaacaaccatgtgctgtctgagcaggtcaggggctgaccgctacaggcccctcagcggttgagcctgttggggggacccagctgctcttggacaagtggctgggctcctgtctggcctcctcttttcctcctcctcctcctcctcctcctcctcctcctcctcctcctcctcctcctcttcctcttccttctcttcttccttgtcttcctcctcctctttctttaagtaatttgtgtgtatttctaactgatcgtattgaaaaaaaaatcctagtatttcagtgacatgcctgttgtgagatgaacctcctgtgacttctgtctgttctgtattgaggctcagggagaaactagcatttttttttccaaactactttttgtcactgtgacagttgtaaataaagtttgaaaatgctttcc

SEQ ID NO: 365 - DNA, 525 bp, Mus musculus
tttttttttttttttttacggcacccaactcacatctttatgaccaggtgggtgtgggaatccccgatacccctgtctgcgccagccaagccctgggagcaacaccttccatcctgagggagaccagctccctgctgaggggctcacaagttggtggaggatgtaggggtattggggtccacagtcttacaggagagaaagttgtatctataatccgaattctcccccctgaactggcgcttgaaatgctgtccaacccggaacagggaggctacatccaacagggcattttcgatgtgctgccccagccggtgagagtctgtttctgtgcttgatttcttgctggagatatggaaggtgattgcgttttcccccatgaagatgtaggagataccatacccatggtcatgggcaggcccaaatccacctccagaggaaacgtaatccggataattgtggacatcaatcagatgtgtctgctgcacagggacatggctggtggacagcatccattgctgcgactgg

SEQ ID NO: 366 - DNA, 2163 bp, Mus musculus
ctgccggttaaatgctgagccaggtaaaaaggtgttttaccctgtggtgttcagtctttacaaccctgccattgtctatgccaaccaggacgtgccgccccctgtggagcagcagctggttcataaaaaggactctggtttttggagagactttggctttgggatgacctgtcaatatcaatcggatttcctgagtgtcggtggattcgacatggaagtaaaaggctggggtggagaagatgttcatctttaccgaaaatacctacacggtgatcttattgtgattcggactccagttcccggtcttttccacctctggcatgagaaacattgtgcagatgagctgacccctgagcagtaccgaatgtgcatccaatccaaagccatgaatgaggcctcccactctcacctgggaatgatggtcttcagggaggagatagagatgcatcttcgcaaacaggcatacagaacaaacagcgaggctgctgggtaacagtcaacgtgggagagtcggaagcacaaaccagcactgttaattcagccttaattccaactctagattatgtgcctcttccagagaaaaacttttcttttccatgttctttctgaaatgtttttgtagctcaacttgatgtaagaagaaaacgcaggtgtcttgatgtatagcctgccttgtgagagtactatagtatgaaacagttgacaaaatgaaattttatatttgtccccaaaatcgtttgaattagattctgcctggtacctgtgttctgattggtcctggagtatacgaggctaatgttgagttggtcagcacactcctacagggaacagaacactggttggtcgaaatgttcaggcagatatgcctgctgaccactaagtcaatcatttgacttcagtctttagatgaaagctttcattgatcacatgtagaatattttttttcacagaaaataattaacatatctaaaatctacagtccatcacaaaggcataagtcaaaaccccttagtttcatgttgctttccctttgaatatgtttttaagcaaatggatatagtagatatagtttagaatttatggtttgattataaataaaatatattgttatgttaccaatgttcaaaattcatagtcaaattgtagtagattgttttgaacattttattatattggaatgcaggacagtagctgtgtttgggaacgtctttttatataagccagaggcatagaagatatgaacgttatagcatggttttgtatggcttttgttttgcactgtcttgtttagcatgggcacatatatatttattttctatatgctaattttgccataattgtgtttgcatttgtattatactttcagttgaaagagttttattgaaaaaaattaaatgcattatataataagaccacccttgatttgagaaaagggaaggaaggaaaagtgacctgataaaaatataaattatggagtactttaaaaaaatgtacagattgaatgctactttaattgaaatgtaaattatattaatgagacaagatgaataagaaattatattccagtagaactgtactataatatttatcacacatggatattttatcattgggtcatttactagatccagaaattggagataaaataaaggcatgcatagtttttttaacccctgacttttaaagggacctgctatttctatataacccatgagaactcagaaaaagtcattatttttgttcagtaaatcataccatctcaaaagttacaaatgccaaatttctaggtgctaatgtgaatccaattcaataataactagttgctgagggttctacccggcatatcgttgaggtattttttaagatgtataaagtgctttctgcagaataagcagagccagtatctcctttgtacacacttatttattgtaaagaccagtgaccatggtatttaaaattagggtacttaatgattttcaaaggtgatttcagcttggttttgagataatcaaatgatttttactttaactcctatttttttaaactagcttttatttgaagatggaagctaagcaatgaaagcattactatattttttacattaagtggtaccaataaagtattttgttaccaaaagctaaaaaaaaaaaaaaaaaaaaaaaa

SEQ ID NO: 367 - DNA, 2339 bp, Mus musculus
acgtactagtcgctctgccgcagccaaccgcgtagccatccggtggcgcaggtgtctggggaccccgagcgcctagcctgggagcatgatcgtggacaagctgctggacgacagccgcggcggagaggggctgctggacgcggccggcgactgcggcctcatgaccagcccgctcaacctggcttacttctacggcgcctcgcctccttccgcccccggcgccggcgacaccggctacctgtccgccgtgccctccgcgcccggctcgcccggctccgactcctccgatttctcctccacttcctccgtgtcctcctgcggggccgtggagtcccgtcccagaggtggcgcccgcgccgagcgccctcaagttgagccccacatgggggttggcaggcagcagagaggcccctttcaaggtgttcgcgtgaagaactcggtgaaggagctcctgctacacatccgaagcaacaagcagaaggcttccggccagcccgtggatgagtttaagacacagagtgtgaacattgagcagctgacagacctgaagagtgcagtgtccgcagtggggaaaagaaagggacccgatcctctgtccgatggaccggtttgcaagaggccagctctgttgccttctcacttcgtgacatcaccgcaaacgcctacacctggggagagcatggaagatgttcgccacagcgaatccaagctggatagcagcgctgccctgcttcagaatattataaacatcaagaatgagtgcaacccagtttcactaaacactgttcaggttagctggatgagccccacggttccccagaactcgccaagagaccagtgccaggatttccatggaggccaggccttctctccacctcagaaataccaaccgttccaagtcagtggctctccacagatgatggaccaggcgtcaatgtaccagtattcgccacaaacacagaacatgcagcagccgccgccgctgccaccacagcagcaacatcaacagaattatccccacaactcacccctgcagttcagtccttactccagaatgtcccagtctcccaagtatgattccaacctctttgatactcacgagccacagttctgcacgggccaaagttttgtgtctttactgactggcccgggggaacccgagtctcttgctgttcccgttccggctcccaccagcattccaccccaaactgagactcagctgcagaccttcagcctgatgccaagcaatgcctgcgaggccgtcgtcggggtgcacgatgtgggctcgcactctttgggcacgtccctgtcactccagaacatcatgggaagcccgatgaataccacccagctggggaagtcattttttcagtggcaggtagagcaggaagaaagcaaattggcaaatattccccaggaccagttcctcgctagggacggagatggtgacacgtttctccatattgctgttgcccaagggaggcgagcgctctcgtatgtccttgcaagaaagatgaacgctcttcacatgctggacattaaggagcacaatggacagagtgcctttcaggtggcggtagctgccaatcagcacctcattgtgcaagatctggtaaaccttggtgcccaggtgaacaccacggattgctggggaaggacacctctgcatgtctgtgcggagaagggccactcccaggtgctccaggccatccagaagggagctgtgaggagcaatcagtttgtggatcttgaggcaacgaactatgatggcctgactcccctacattgcgcggtcgtggctcacaatgcggtggtgcacgaactgcagaggaatcggcagtctcattcgcccgaagtgcaggacctcttactaaggaataagagcctggtagacaccattaagtgtctgattcagatgggagccgcagtggaggcaaaggatcgtaagagtggccgcacagccctgcacttggcagcggaagaagcaaatctggaactcattcgcctctttttggagttgcccagttgcctgtctttcgtgaatgccaaggcttacaatggaaacaccgccctccatgttgctgccagcctgcagtatcgggtgacacagttggacgcagtccgcctgttgatgaggaagggagctgaccccagtactcggaacttggagaatgaacagcccgtgcatttggtccccgatggcccagtgggagaacagatccgacgtatcctgaaggggaagtccattcagcagcgagcaccaccatactaggtccactggcgtggagcctggttcagcgacactcactgtcagttaggcagtcctgatgtatctgtac

SEQ ID NO: 368 - DNA, 679 bp, Mus musculus
ccagttggggcatttcgaggtttagcctttagaattttcatttttgttttactttttttttccaatttagaccaaaaagaaaaaaagaaaagaaaccattgtaaacacacacgtgtgcgcacgggtgcatacacacacacacacacacacacatactccatttgccagaagcaattatgtatatgttagttggagggtattaaagaaaaaagaaatctgatttattccaaagatttaaaagtggacatgacttagaaactgctctggagcactgcttgctgacaatctcgttctctactgcaatcgagtgcattctgcagccagtccatcagggcataccatgggattctatttgaatgtgtgctgcatcctttttttggatgaaggacgtgtgagggaccttgaacctcaactgtattgaactgtagcgcctccagtcagtgcactagatgaaactttagactgcccaaattctgttggtttgtttctctcttcccagtctgtagcagtcagtgtccagcatgaatgcacgcacacgccagggatggcattaagccatggctgccacgatttacagatgttctctcccaggctggagctgctcttactctcaaattgtcattactaaggtttatagtacttaatttaatttttttttgtactgaccaatgcaaggctc

SEQ ID NO: 369 - DNA, 697 bp, Mus musculus
  modified_base (262)..(265): a, c, g, t, unknown or other
tacattttgattttcccttttctttctccttgccccccttgaccgctagcccatgaggtccaagtgggaatccaaatgagcgatgagaggggagaggaaaaggtacaagccagcagaaatctgactgttattttgggctcagctagttttctgtcctctggactcattccaagggaggagaagcactcagagacagagtccactcctgaaggtctcagagtgaagacactaagacccccaagactttttttttttttttttnnnntgtgacagggtttttctgtgtagccctggctgtcctggaactcactttgtacaccaggctggacttgaactcagaaatccgcctgcctctgcctcccaagtgctgggattaaaggcgtgcaccaccactgcctggctaccccaagactcttgactctgcttgcaaatttagagccagtgggctcagggacagggaggcctcagcctttggggtttcaagctggctggagcccagagtcctgccctctgaggacccaactactttgcctccatctacctccgccttggtgattccctccctgcctcacatctggggcccattagcaccctctttcctggttggtggaaagtgcaagaagatgggaggcatacctggtgctcaacacgcagtaggccttcaataaaagccacttgcattagcattttatacttc

SEQ ID NO: 370 - DNA, 764 bp, Mus musculus
aacatgggcattcttatgaatgtagaaaatggatcctgagccccaggccactggatgcagaagctggtatgctttgttttcctaaacagagaagaaagggtttccaaatcctgtcctccaagctgtgcctttgaaagggctggtgaggtggcccctgtctgtgaagactggacctctagtcgcctgccccacgagactactatgttaggagtctgagctcagagcttccgagctgatgatgggctacagtacaggaactcaaggacttccgctcttgctgctacaactggcagccaaagtgaagaggttggttctaggtcgggcctagctctaatgtgtctgcaggctgaggcagcagagtgccttccagttaggacaggggtgcaagagcacacttgtcacctgggatctgtgactctggggcatgaaggacaaggcctcggtggaagagaagctatgtcccctcccatcctgtcctcagtcttggctccccatcctctggcctgtttgtggacagatgctgggacagcatcaagaacagctaccttagaaactatttattcatcagaagcccccagggcttgcaatcctggaaagatattttcaacttgctgcttgtgcgggatgtacaaaggaatgaatggtattttattgctgtaatattgtataatactgtaactataccttaatgttgttacttactgtaaatgtgctatggttttatctacaataaacactcattaacattggctaaaaaaaagaag

SEQ ID NO: 371 - DNA, 478 bp, Mus musculus
  modified_base (346)..(346): a, c, g, t, unknown or other
  modified_base (380)..(380): a, c, g, t, unknown or other
  modified_base (411)..(411): a, c, g, t, unknown or other
  modified_base (423)..(423): a, c, g, t, unknown or other
  modified_base (434)..(434): a, c, g, t, unknown or other
  modified_base (438)..(438): a, c, g, t, unknown or other
  modified_base (463)..(463): a, c, g, t, unknown or other
acacttctgtgtttaatatgccacatcttcagttgctcctggggtggaatgtgagaccttgactcttgtagtgatgtcagtgggtgggcatgaggctgtgaagaacatcttgccacacagatgacatctctggagtaggtgcacgtgcacgaggcgctcagtacagttcacctatagtacacctgctaaaagtctcagtaggcaatggctgccagatggctatatgacatctaacaaagagacagtggacacctgaggtagctagtagcccagcagagacaggagtacaactgttagaggagatagattccaggaccacaatgcttttaggaaccacagtgctctnaggaagtggtgttttcatggggacactgggctanccaccacctgggaacctctttctgaaccctnggtgaaaggggnccgagctattntggnttgttgggcttgcttcttaactggntatttcctagaggct

SEQ ID NO: 372 - DNA, 1685 bp, Mus musculus
aagcaacgccccttccagccagttagtggaagccgccgccgccaccatggtgcaggcctggtatatggacgagtccaccgccgacccgcggaagccccaccgcgcacagcccgaccgccccgtgagcctggagcagctgcgcacgctcggagtgctctattggaagctagatgctgacaagtatgagaacgatccagaactggaaaagatccggaaaatgagaaactactcctggatggacatcatcaccatatgcaaagatacacttcccaattacgaggagaagatcaagatgttctttgaggaacatctgcatctggatgaggagatccgctacatcctggagggcagtgggtacttcgatgtcagggacaaggaggacaagtggatccggatttccatggagaagggggacatgattactcttcctgctggcatctatcaccgcttcacactggacgagaagaattacgtgaaggccatgcggctgtttgttggagaacctgtgtggacaccatacaaccggccagctgaccattttgatgcccgtgtacagtacatgagttttttggaaggaacagcatagcagtgctcctcgaagagaaaactgcactgtgtgaatctcctgctgtggtaaccgaatggaaagttgctcacttttctgcttttctatatgaacttgaggctagactagctctctttgctaagattgtgagatcagtgtctttaaatgaaagcatctctaaaagtgatttttacatggaagccacaaaaatgtgaaaaagtgaccttaattttccctaactgtcaagacttagaggtataggagccctggattggtatgtgcattcatgcatggccaatcttcatctcccagatctttaggtgtctgttggtgtgaagctatgcctcctgcaagagggcagttataaccagcacaactaaccagatgacgttttcctcctttgctgattgttgattggggaagtggggttgttgttctttcttaaaactaagttaccttaattgtatgctcacagcttagctgtatgtacattcatgtgtacctacagtattttacttggttcattaaaacctcccatttagattccttatgtgatttttatatgtacatagtttctatatcagggtgaaagatcctgacagaatgttaaaggttacagaagccctgaaattggcaaaatagatttcattgttaacagaactagcttcactgatttagaaaaatagaggtgcacaatgctctggccgctccttgaacccgtgtgtctgccaatgttttgaccgttccttgaacccatgtgtgtgcccactgaagaagcccattgccaggtgtttgtgatattggttgctggggaagagtcggaaaaatctccccagcaaccacagccgagccaatccggagttgctacacctgcaccagactctttcttgtacccctcccatacccatttcttgagaaatcattttagaatagatattgtttagattgggaaatcccctactccttccttctcctttcccccctgagggcctataaaaactgggacccctttctcctcggggtcaactcctctacccctgcgtgggatatgagtcattcccagagctctggctttccccaataaagcctcgtgtggtttgcatcaaaaaaaaaaaaaaaa

SEQ ID NO: 373 - DNA, 319 bp, Mus musculus
cacttctctatcctcatcacccaccgcaagcttcccgctccccgaacctcaatccttttatctatcaccaagccctcccactccttatgcatctaaattatccttcagctctttccactgaatctcattcccgtcctgctttaaggctttggggactaggctgggcctgcccccagaacccgggcaattcctccctccttctccacttttataaacccaaccctttccccagaatagtattaactcctggtcctttgtactactggttcaccgccctcgggcttcttttctatattaataaagaagagtaaaaactccc

SEQ ID NO: 374 - DNA, 2351 bp, Mus musculus
atggctgatgatctggagcagcagcctcagggctggctgagtagctggctccccacttggcgccccacttccatgtctcaactgaagaatgtggaagccaggatcctccagtgtctccagaacaagttcctggcccgttatgtatccctcccaaaccagaacaagatctggacggtgactgtgagcccagaacaaaaggatcgcacccctctggtgatggtacatggctttgggggcggtgtgggcctctggatcctcaacatggattcactgagtgcccgccgcacacttcatacctttgatctgcttggttttgggcgaagctcaaggccaacattcccaagggacccagaaggagctgaagatgagtttgtggcctcaatagagacatggcgggagaccatgggaatccccaccatgatcctcctggggcacagtttgggaggattcctggccacttcttactctatcaagtaccctgaaagagttaaacatcttatcctggtggatccatggggctttcccctacgaccaactgaccctagtgagatccgtgcacctccaacctgggtcaaggctgtggcatctgtcctgggacgttccaatccactggctgttcttcgagtggctgggccttgggggcctgggctggtgcagagattccgtccagacttcaagcgcaagtttgcagacttctttgaggatgacaccatctcggaatacatctaccactgcaatgcacagaatcccagtggggaaacggcattcaaagccatgatggagtcctttggctgggcccggcgccccatgttggagcgaatccacttaattcgaaaagatgtgcccatcaccatgatctatggggccaacacctggatagataccagcacagggaagaaggtgaagatgcaaaggccggattcctacgtccgagacatggagatcgagggcgcatcccaccacgtctatgctgaccagccacacatcttcaatgctgtggtagaagagatctgcaactcagttgactgagatgccctgagagggagaggaggaagccagagttgctgtcatctgtgtccctgtcttagtcagaacctctgtcctttcctcaccaactaacatgtgccagccaggcagagtctcgggctgcccccaagataggaccacagtgaacaagagcacttccaatcccatgcagagggcaagaggcagaatccaccaaaggccttgaactacccatgctggggaaaagcataaagggctgcctagtaccgcccgttccctccacgccaggtggagactacaaggagactgggcgaaccacaccgtctccctgcatggccttcccttcctctagacagaggagggctcccagcagcctttctagtttggcagtgcgactgagagaagattccacacaggaacatctttcttctccatcactccacgcctccatccaagctcagtttccactcgcccaccagaagcagctctagtcacctgcacaaccgcttccatgaccttggaggtatatcccaagctctcattggcagatgaggcaagagataagggcaggatatagcacatgatggcttccagcagaactgagtctatagcccaggtctgctggcttccagcacatgttgtacactaagatttcatgcagacaccattgctgtggagccgattgaaatttaaccctgctccatattctaacctgttatgcaggtacactgttatcttgccctgtgtctcaatcctggttgtctaagttgggacacctgagtctcttcctcttgttccttccactatgaggctctgagcctctctgtgccttgggccctaaagccccatgtgtagtatagagcaaaggtgattcctggtggagaaggggaaaagcccttctaccctagagtcatgcctggatccacaactccacaggtatctgcagcattttctacctggccctatcgctgagagcccctccccatggctcactgaggagcactcagccagcagttctctatccttatcagccacagaatgcttctcactgcccgaacctctatgctctcatctgtcaccatggcctccaactccttctgcttcaaaattatccatcagctctctccagtgaatctcattccaggtcctgctctaaggctctggggactaggctgggcctggccccagaagccgggcagttcctgcctccttctccacttttataaagccaagcctttccccagaatagtattaactcctggtgctttgtactactggttcagcggcctcgggcttcttttctatattaataaagaagagtaaaaactgtcaaaaaaaaaaaaaaa

SEQ ID NO: 375 - DNA, 694 bp, Mus musculus
ttttttttttttttttttgagcttaatgaaattttattttgaaaatatggcaagagtctaaggcacttcaaacatttaaatacatatacaggaccaaagtaaacgtggcgtatgatagaaatacacagagaactacactctgcctccatagacccaaatctggcacccagtcctctaacctaattcaaacctttatcaccagatatagacatggttgggcagatgctcaaaacgtaacattgcatgtagctctttatgactgtactgtggaatataaaagttgaaaatactgttgtcaatttcatatagaagtcttttatataaaaagccatataatacatccacctcgataaaccaattgaaatatttcttgtaagtttatacatatggtttgagagttccatcttctatttttaagcgggaaattatcagcgtggggggggggcaagttgctgacgatcaaagtcctctcccccaaggttcttattttaaaagacaaaagagaagtgaacagaagcaagaagcacccttggaatggaatactggaaggacttcccaacggctccacatttcataagttactaagcacttgtggaaaaggtcaaaactacaatgtcatagagaacctgacatttgcttatatggtagaaatggcctggtcaggccagtctaccatttcctaccactgcaaata

SEQ ID NO: 376 - DNA, 317 bp, Mus musculus
agcactctccccttccccaatatcatttccttttcttctaccttacatgtctcatggcaccatccccttcttcacatcccccgaccaatatttcttcgcggttcacttcagtgtttatgccatctaatctaatccttctttacgcgtctacatccaccctgtatccacattttaccacccggccatacttgcaggatgcagaccctagtgggctgtactgtatgcactttgatgcagacgtgaaaagaatcttttgtactttttattccatctgtatagactataaaactatttttattaaataaatattttacagt

SEQ ID NO: 377 - DNA, 3554 bp, Mus musculus
ggcggacttagggaaagggcgttcggctagcgagctgtggccgccggcgggcggtggggactccaagcaccttgaccctggcgcgaggcggcgtcgcgcacgcttacaggtgcccgcgcgggctcgcggctcgggcgccctcccgttggccgagaaggaggagggggccgtgtcggcgtccagcccctcgcgcccaggatggacgtgccagccagggtgtccagacgagcggcggcggcggcggccaggatgcttctgcgtactgcccgcgtccctcgcgagtgctggttcctgccgaccgcgctgctctgcgcctacggcttcttcgcaaacctccggccgtcggagccgttcctcacgccctaccttctgggacccgacaagaacttgaccgagagacaggtctacaatgaaatttatccggtgtggacgtactcttacctgctgctgctgtttcccgtgttccttgccacagactacctccggtacaagcctgtcatcctgctgcagggactcagcctgattgtgacgtggttcatgctgctctatgcccagggactgctggccattcagttcttggaattcttctacggcatcgccacagccaccgaaatcgcctactactcctatatctatactgtggtggacctgggcatgtaccagaaagtcacaagctactgtagaagtgccaccttggtgggctttacagtgggctccgtcctagggcagatcctcgtctccgtggtgggctggtcactgttcagcttgaacgtcatctccctcacctgtgtttctgtggcttttgctgtggcctggtttctgcctatgccacagaagagcctcttctttcaccacattccttcctcctgtcatggagtgaacggcctcaaggtacaaaacggtggcatcgttactgataccccagcagctaaccatcttcctggatgggaggacattgagtcaaaaatccctctaaatttagatgagcctccggtggaagaaccggaggagcccaagccagaccggctgcgggtgttcagagtcctgtggaatgacttcctgatgtgttattcctcccgccctctgctctgctggtccgtgtggtgggccctgtccacctgcggctatttccaagtggtgaactacgcgcagggattgtgggagaaggtgatgccttctcagaatgctgacatctacaatggcggtgtggaggccgtttcaaccttgctgggtgctagtgctgtgtttgcagttggctatataaagctatcttggtcaacttggggagaaatgacgttgttcctgtgttctctcctgattgctgctgcagtgtatgtcatggacactgtgcagagcatctgggtgtgctatgcatcctatgttgtcttcagaatcatctacatggtactcatcaccatagcaactttccagattgctgcgaacctcagcatggaacgttacgcccttgtgttcggcgtgaacaccttcattgccctggcattgcagactctgctcactctgattgtcgtggatgccaggggccttggcttatgtatcaccactcagttcctgatttacgccagttacttcgcagccatctctgtggttttcctggcgaatggcatagtcagtattataaagaaatgcagaaagcaggaagatcccagctccagcccccaagcctccacgtcctaacgggctcccgaagtgctgctgcttccaagcaaggattttgcaccgcagctgcttggatgtatttaaactcctcatggttcagatagctatttctgaatgtatatttcatggcttcaaagcagctactcaactaacaccttgcagtcttggagttagtataatactgctaagagaagccggaagcttttttttcttggattgcttatgagcagtaatttaagaaaacccacaaaacttgattgtgaaaaaccgaataaccaagcagcgcgtctgctctttccctgattcgcatgtgactgtgatgctttccagtcacattcatcacgcactcagacctgtggcctggtgggaccagggcttcaggagccacaggatggtacaagcctcgacagacacgttctgtcagcacttgccccggccacctcattctggtttcagtgttacttgtgcgcatgtgtgtgtgtgtctgcagatggaaatcattccccactggcagtatctgctcgggttcaacgctctgtcctctgaggagtgttgtgtctgattttattttaaaagttcacggtatgagagttagtgcttcttcccaatttgaccgttgtatatttttggaaacgttctttagaatacatttctgcattatttgtatgcttcccagagaagctcatttcattacaaaaggcacattttaaagcctgctgataactgaggagggctaatgagataggtttgctcgtctgtaatagttatgtatgaaggactcttaattgcaactgaaaaggtcgtgtataggttagagatacagggagcccattttatatttgcatacccttttatttccaaaacaaaatgagctcttttcccttgagacaatatcattcccatatacctctcattgtcttggctttcttatccaagacgagaagatatcagtcggaactggattattccacagcctttttataaactgagcctcttcttaatgattgttctgggcttggcagtaggatagacttgatgcctgcgttttggaccttagacctgcccgccttcgttcctacagttagatcatcttgagagatacttaaaagtatctcctccttacttgaaagaatgatgttctacatgctaatatttgtgagacatgaaaactatttcaaagccaactttgttgtcttgttgtataagaaatctaggtaggtgctttcaactagagtgttgaccttgttaagacggacgtagctgcacggtattctcaatactgagattgcaaaactgaagcttgacaagtgtgtggaagaccctggctcaagttccagcactggaaagaccaaagtgcaaacgtgcatgggaggagtgagggtaacagaggccatggcgtacgtcttcctttgcagctagggaaagagaagaacactaaggagatggagaactaaggtcagagtagcagtctccagtcttacattttggtctctttcctcctatacttccttgttgctctataagaagttggttgcccagaaacaagaagaaacattgtgattgcgaagtgtcattttgttttttttttaaataacatgtattatggcacaatcaaattgttcacattaccaaagcaatatttctttgggattcagttcagtgtttgtggcatctaatctgatccttctttacgtgtctaaatcaagactgtatccacattttaccacgcggccatacttgcagaatgcagaccctagtgggctgtactgtatgcactttgatgaagacgtgaaaagaatctgctgtactttttattcaatctgtatagactataaaactatttttattaaataaatattttacagtaaaaaaaaaaa

SEQ ID NO: 378 - DNA, 681 bp, Mus musculus
cgggaaaatatttattgttgttataagaaagaagtttctctggggagcaaaagaataccaggacacaatagagagggccaggcgggacaagaactcggaaacccgcagggcgtgtgccttcgaggggggggaataaaaaggggcggccaccactgcccagcagaaaaaaaaatttttaaacctattgcggagaacccctttctagacaaaacataaagccggaaaaataaggggggggcattaaaaaataggtttggacacacacacacacacacacacacacacacacacacacacacacacacacacaaagcttgaaagcatgctataggaaacaggttaaatcaatacagctgtgtgggtggaaacgagtctgcagtgagttctgtcactgctggggaaaagtgtgttttgacttctcagagaacgtcactagggtctgtccagcagcacccaaagactcagtagtgacaaggctgagttcttgcagggtctccatggtttatgttgccaggctcaggccacacggcttcctattcatgtcttggtgacaggaatgagatgaagagtggggagcgcttaacacagagcaggggttgcgcctacagcaagacttatttgctaccatatggtttgtaatcaaatgatagggaactgtgcagaataaagaatattctttgg

SEQ ID NO: 379 - DNA, 3615 bp, Mus musculus
caggatggattttctccggcttcgtctccctgggctacatcaggctttgaggggagcactggactccttcagtgcgtttgtgtcctacctcgtaggagacacagtccccacagtagagaggcagacacaggcagctgaggaactgggagaggtgactgaggggaaggttgtaggagaggaagcccaggaggtactggagggacttagaagtggccagagtgagggggtagaagcacccgaagagactagaagatgccaagaaggaagtttagctggtgaacagacctgggggtggagagcagatagctctgcaaggccccaagcagaaaggcaggacactgggtcctggaaggcagctgaggatgccaggggccaggagccaagtgtcccactgaagcctgaggcagagcctgggactcacagagacaggagcagtaatacagcccaggagatctgggagcacggtgaagaggaagcaagcagtggggagcctctgagaacctgtgaacagaaggaagaagaggaggaggtggtcagagcagcagagtcagggatggccgagggggtggagtcacagccaacctggcacagcgagcctggggggaatgctggcactgaggggcagcatgtgacagaggacagcaaagagatagactgggtggccaaagacatggttgcagaaatcgaatggtttggtgccaaagggattgacaaggaagaggagaggatggtcccaatgagggatggtgaaagggcaagggcacaggggacacaatgccccggggccgagtctgaggaccaggccatgttgagtagagaggcctggacagtctcagacagggagggggctgatagcctaggagttcagggaacagaatacgggtcagacccaggagacaacttcccaggaactactgggagagtctgggtcctagaagaggctgacaagggagaccagcaggatgaggtcgacgagaagagagaggctgaagttaggtttccgatccagaccctggaggctgagagaactggagagatgactgaaggccacatagctgaagaggaggctatgggagaacaggaaacagagggcagctttgaggatgaggagaggcaagacttagccatcagggataatggagtgagtctagaagaagaggtacgggcagaagaatcctccagggagaaaaggaactcctgggccacagagcctacgctagtcctagacacggaggctaaagatgaacctgactgggaagactctccagaagtcagcactgaggagttgtttgtgggagagaggagtgaagccgcccagatgacaccagaggtattgagagtaaaggtcactgaaggacaggaccctgagctggtgagacattcccaggctttaactaaacaacttgaggaaggacagaagggtcaggaagagactagtggagctccagacctgagcccagagcgggtgctaagcttgaaggaatatcctgggcctgtggggtttgcaggccctgagctagaagcctggggaaactggagtaggggtgtggaccgcagaaatagccaggaggtaaaagcagatgctgaagcaggcaaggaacagactgcaaccgagcaggcagtggagatccgggctgaaggaggccaggaggcccaacagccagaggtcttcgggtcaggaggagaggaggcactgacctccgtagcacttaacccggagctggagggaagccaaggagcagaggcggggacagaagagtcagtggaggaatccaagcccacagaaaacgaggctgctgaggaggaggctgtagtgccttgggaggcagatggaacttgcaggaagaggaggctggaggaggtgactctgagcctgcaagacagtgaggacacagagaccagttatttggctgaggagattattgtgggtatcagggccgtggataccgaggaagggccaaaatgggaagctgggttggctccagaaacagagcttgggaaagcctggtgttccgagggcagaggggaggctgggagaggcacggagctggaggagactacagagaagcaaagtggacaggaagttggcttggtgggctcagcagagaaggtgtctggctatgatatccaagaaattgatgggactgaagagggggagcaggcagagatggagacatctgtaatggcagaagacataagggggacggatggtgtgactttaggctcccaggcagagagagcagaggggtccataacccccatggagactgaggggctcctaagagatcagatgctgttggaagaagaggctgggggagggcagtcgcgagagcagaaggtccacaactcagagggcgagatccaaacgctggacgactcttcagaccaggaggggcagcagacacaccaaatccccacagtagctgtgcctgggcccttggaatcggctgaggccacggcaggtgccccaggggatgttcacagcaactggaatgaggccctgctccctgggtcccgcctggatgtctctgtccctcggagtcgtgtgctcctctctcgaagctcctcacggcggcgctcgaggccctctttccatcgaatctctgttcctgagccacagtgtgaccctcccagcccccaaccccaggcggagcggccggtccctgagcaatcctctcttcagctagaggaaactccagagctaagtgccacaaagcccgaggggactccagtgccagccagaagaaaaatgctggggcgtgggtttggctttgctcatcctggcatgatgcaggagctgcaagcccgactgagccagccaaagccacagtgacagggcctagagccctagagagagagacctcccaagagagtccgaaggctcttctggaccctggttactcttgagtccctcggccactggaatatatcttttcaccctcccggcctcagctaaactggatatttatgaagaccttgaatctaggagtctgattaagccagtgaggaacctgctccactggcatcgatcatggattcctttcccggtgccctttcacatctgtctcagctactcggaaggctacccggaagactgggctggggaaactattttcccctaaatttccccagtatgctcacctgccacccaatgtgagataagaccagcaagtgtaagtgtgcttgcgtgtaagatagcacacttctggggtggaaaccagcccaaaggaaagaggttcaaggggctgagcaagggacaccacttggagtccacggccaccggcaacagatcagttgctttgagtttccaaaatgacggctcggtatcacagctctgcaggttactatgctaacctccatgccagagttggggaacgttgcccaggaactccaagcacataggagtagagaggggttctgtgtggctggaagcttccccctccccccaactccatcccaaaccggcctgttccttgggtgtcagaccttcctgtgaaaagatgtggaaacacaaaccgggctggatggctttattaggcacccagcatggtggcctaactcaagagtgaaacaataaataaaccatttcttaaaaataaaaaaaaaaaaaaaaaa

SEQ ID NO: 380 - DNA, 1255 bp, Mus musculus
ggaattacagcagagtgcctgccgtgtggaggactgctcgcattgtttgttgctgaagagcaggacatgaaacagtacctttgaccggagcgtgaccctgctggaggtgtgtgggagctggcctgagggcttcgggctgcggcatatgtcctccatggagcactcagaggagggcctccgggaacggcttgcagatgccatggccgagtcaccaagccgagacgttgtgggatctggaacagacacagcccttgacgtagcagtcaaaaacagcacccccgagagacccatggctgtgaagtgtttggggaaaaaaaaaggaaaaaaaaaacaatgccaacagcccagcgtgcgtgaacagcccaacagtaacaaagcgtgcgttcgagacggaggaagaacttcagcgagagggaagcatcgagactctgagtaacagctccggctccaccagcggcagcatcccaagaaacttcgatggctaccgatctccgctccctaccaacgagagccagccgctcagcctcttccccactggcttcccctaggcaccagccacctgcttctgactggctggcccgctcacccctagagggactgactgggaggggggagtacccccatctccctacaccaccaccaccacccctgtcccgcacgcctctgttcccacccttttcagtctcctcaaccccaccttccctaagcttagtggcaacagctgttcatcccaaactggacgagaagagaccttcagaacacctcggtacaccctgacctcccccactcctgtcagtgggggctgtggcccaaagagactgcagaaactcagtcccttctctctttgcacacaacgtcccgcactggatccgcttttgtattttctaactactcacaggggactggaacaggggccagatcttagggcctctggtaggggagagttgaaagatccagccaggcattttggtggacatcagccctagcccagttcaggctgggatgcacattgcccccaggtacccctgctcagttctaaaacaggagtgaactgagacctagagcgatagagaggaagaaggaaagaggcctccccttgcccttgcttccctgttggctcatggagagatttgtctgtcttatctttaagcccttgtcccctggtcctgtactgttccatgaagggaagtgcagttaccgaggccgtgtcaaaagtgcacgtcttgtccaataaatctcgctgcaattggtgtcc

SEQ ID NO: 381 - DNA, 435 bp, Mus musculus
ttttttgatgtaacaacaagaggttttttaatggcggagctccgggtcgaaacgtatctcacacaacaggagacagtggattcgaccacgaggcttggaagctagggggttttatagaaaaggagtggggctgggggaggaattggcgcggtttcacatgattggtccatttaaacatcagcagcctgtaacatttaacttaggtcagaggggtgggagctagggaggcgatgggcttgcccgggcatgtcctggtctgttctgctatgttctcagccccaggtttcaaagctcagaaacaactctttgggctatttaacatacattacatgaattacagttttatttcctttcattcccctctttttctgtttagactaattctaatcatagaattttagaggtcggtgtcccttaactcttcatctacctgaa

SEQ ID NO: 382 - DNA, 1398 bp, Mus musculus
ccccagcctaagctccccgctcccagtgcctggttcgccgaacgaggtgggcagacggctcgggaccatgactagagctggcatggagcggtggcgcgaccggctggcactggtgacgggagcctcggggggcatcggtgcggccgtggcccgggcattagtccagcagggactgaaggttgtgggttgtgcccgcaccgttggcaacatcgaggagctggctgctgaatgtaagagtgcaggctaccccgggactttgatcccctacagatgtgacctgtcaaatgaggaggacatcctctccatgttctcagctgtccgatcccagcacagtggcgtggatatctgcatcaacaatgccggcatggcccggcctgacaccctgctctcgggcagcaccagcggatggaaggacatgttcaatgtgaatgtgctggccctcagcatctgcactcgggaggcttatcagtccatgaaggagcggaacatagacgacgggcacatcattaacatcaacagcatgtgtggccaccgagtcccaccccagtctgtgatccatttctatagtgcgactaagtatgccgtcactgcactgacagagggactcaggcaagagcttctggaggcccagacccatatccgggccacgtgtatctctccaggcttggtagagacacagttcgccttcaaactccatgacaaggacccgggggaagcagctgccacctatgaacacataaagtgtctcagaccagaggacgtggctgaggctgtcatctacgttcttagcacacccccacatgttcaggttggtgacatccagatgaggcccacagagcaggtgacctagtgttctgtggggagatcctaccttctccacccttcacggctcgcctcctgcctctggattttaggtgttgatttctggactctgcagcttactttctatgtccaccccactaagggatagacagcttgtcagactattcccattacaaatgtgaaaaactgggccgggaagagaagacagaatctcgactgttctatctaacttcttctgagtcctcttggggctccgtaacctttgctctcctgtgcctcttccttttgacctaggaaagggatgtacctagaaggggcattgctctatcctcttacaccctaccccccaccccttagggttggagcagcagagacctcatcttttacctgtgtggttgtccagggttccaggttcccttcccaaccctcctgcctcccccccccccagctctccagccaagttttggccctcaccctggggtccttaccacggctacagagtatcagggtctgtctcctactacatttcactgtaacaattaaagagagagattacaacctaaaaaaaaaaaaaaa

SEQ ID NO: 383 - DNA, 556 bp, Mus musculus
ttttttttttttttactgggtttatatactttttattattctgattgttttcatacatgagtactgtatttacatcatttccacccctcttcctccaattcctcccaactccctctcaaattcacaatgtcttttttaattatgattgttacatatatatttatttacatacacatgtgtttaaagaaatacactctgctgtccatttagtattggtcgtatgtatttgtgtttagtatttgggattgaataacccatcagggctctgtccctgaagaagactagttctgcctctcttagcagccattaattgcctgtagttcttcatctggtgatgagccttgtaagatttccccaatccagtcaggcatggcaactggtattgtcattgtgttgagcttgttcagctgttcacgttgttgaaatttcatgagtgtagccatacagtgattagtctatataccagcttgtggtattttgtactcatagagaaggctgaacaggttgtatttatattttgctttttagccttggcagtggcaatgacaagtaagag

SEQ ID NO: 384 - DNA, 497 bp, Mus musculus
ctgtttaataaagtttttattataaaacaaccatgttaggaaagccacaaaagttgaagtaaacatttaagtaaaaactaaataaacatgccaagagctatgattctaaaaaaccctaataaatgtacttggctaaatccatatccaagacacaaatttattttgccacttaacaaaaaatgaagcagaatgcccttcattttcaatgtatttttaaatgtttgcacattgtattcctgcaggcagctgcagtataatcaagtatataaacaaaaatcatttcctttcaggttgaatgaacaagtcacatagaaatgtgcaatatactccaggacagccagggctgttacacagacacactgtccaaaacaacaacaacaaaatctcaatataaatgtttaagaaaacaccaatgttatataggtaatataattcattacaaattacttttcttcattaaaactatctgctttaaacacaagaggggtgtgaggccc

SEQ ID NO: 385 - DNA, 519 bp, Mus musculus
aagaatcttccagttcagaagaacaggaagaaaaggaagtgtttggaaattgagccttgaacaggtaaggtttcctgagctgtttgagccaagcccgggtgcaggcattcagtgaggcattcttcttccaccatgccacaaagtaactgaagcttttgcagccaacggaacctcatcaggaaacagtaccacactccagcggagagatgccaaactgaaactatgtgtgttacattcacagggatgctgggtgctcgctgtgcttttgcttggcaaaccaaaccaacatttgttctccatattccatcgacgtgagatcagtagatcctggcgagaaatttcccagatgtagtttctcctatgacagccgtcaatcatctcagcaagcatgggatcccaagcttggttttaacttgggttaaagcaatcggcgaggggcaggcagcctctcttctggtggagcttgcccagagtctgatgggtttgattgcatgtcctaagactgttccatgcagttcc

SEQ ID NO: 386 - DNA, 1622 bp, Mus musculus
gcaactccagctcagccgctgcatgttttctgagcagctttccttccgggcggctggcctggctacaccaagatgcaaggcgggcaggaggtggggagagagtcagtgagtgacctcgcagaggagcctggagaggggtccccccaccagacagctagaggacagagtggtgatggtttggaacggaggcggatctgctgcgacggtcccgtggttctgccggacgcgaacgctaacagctccaggctggatgagggtcttcccaccagctgtccacacccgggggagctcagcggcgggtggggagagttcgaaggcttccgggagtcttcagctaagtcggagcagttttctcagtcttttgaactcctggggagagccacggaatgtcagccgctgagaaccccttcagtccccgaagagggcagttcttgccaggtgcagcagggtggaccctgggtgacaggaactgctgctggcccatcttcagagtccattctctgctatgagaaggtttttaggcttgcgtttcaagaagtcgccgtggaacaggctcctgaagacgtttgctccctggaccacttcttggaaagaagcaatgaaggggctgcatctgtgccgagactctgttctgaatctaggaagctctggagagccctgcagaacaccgacactgcgtctgcttcgaggtgtctctggggcgaatctcactgtcgggaaaacctccttcctgtgcttggtgtagacgctgctcagaagagcccccctggaggccagggtcatgtcctggaaggttctgacttcagaaaacctgaagagctgctggccgtcagcggtttccacctgcaccactgcaaagccctgattcagaccaagctctcagggacgtccagtagcagacagggcagcctgattacctacagcctgtttctgaagacaccgctccaagggaacgggcgctacatcaccattccacaaaaaaagatctttactccacgcaacctgaaaatggcattctttaataatgatgtctgctaaaaacaggagtactttgtacctttatgagatgttttacattttcttactggcttgctttggtactagaacttgagaattctgtggcactgtttcccagttccatgttagtttcctaggacctctgtcaaactaccgtataacacgtgctcaggtctgatagggagcaccgatgataaggggcagagccagtctccatggagtttctggggacactgtaggctggtaccaggtaactgttgacccctgcgtggctcacagttggatccatgagttcagaagtcagaagatagctgctgatcacttgcaggaacatgacctggccctggccctcccccgtgctgtttcctggggtgttatacctatctttctctgtgttggatcctcacccagcagcctcggggacaagcttcactctgagtgggaaggtgggaggacacactgggtgtcccttggtcatctgctgagacaagggttttactccagaggcatacacaagcaggcagcgctgcattttgtaaacttttattaaaaagaactgtgtaagcctgaaaaaaaaaaaaaaaaaaaaaaaaaaaaaaaaaaaa

SEQ ID NO: 387 - DNA, 325 bp, Mus musculus
cagggtttttgttttattttaaaaagttcacacagctttccgcctttgccccagcactgcttttgatggctctatcccttctctgcattgagtcagcacagaacaaggctggtgatgggcagaaggtacctctcagcccccagcagatgcattgggacccaccccactcccactcccaggccagggtggatgcagtggggaggtgggacggaatgtgggtgagtggagagttgctggcggaggacaggaggcacctctgcccttgtggcactcaggagccaggaagcagggcagggtggcgtgtaggaggcaatggcaggggtct

SEQ ID NO: 388 - DNA, 2638 bp, Mus musculus
ccacgcgtccggtccgctatggaggcggcggatgttttccacagagcccggggcaggaccctggacgcgttttcctcagaaaaggaacgggaatggaaaggtccattctacttcgtccaaggcgcagacactcagtttggactgatgaaggcctggtccaccgggaactgtgacgctggcggtgacgagtgggggcaggagatccgtctcacggagcaagctgttgaggccatcaacaagctgaaccctaaacccaaattctttgttctgtgtggtgacctcgttcatgccatgccaggaactccatggcggcaagaacagaccagggacctgcagcgagtactgaaagccgtcgaccaggacatcccactggtgatggtcagcggcaaccatgacttgggcaatgcccccacagccgagactgtggaggagttctgccagacatggggagacgactacttcagcttttgggtcgggggcgtcctgttcctggtgctcaactcccagttcttgtacgatgcctccaggtgccccgcactgaagcaggcccaggatcactggctggaccaacagctgaacattgcagagcagaaacagtgccagcacgccattgtcttccagcatatcccgctattcctgcagagtattgatgaagatgacgactacttcaacctcactaagaccgtccgtaaggaactggccgaaaagctcaccagagcaggtatcagagctgtgttctccgggcactaccacaggaatgccgggggaacctaccagaatcttgacatggtagtttcatctgctatcgggtgccagctgggcaaagacacccacgggctccgtgtggtggccatcactgcggagaagattgttcatcgttactacagtttagatgagctgagccagggtggggtcgaggaggacctgaaggagctgctgaaggagtgactggctcccacagagtccacccagccttcacaccatcaccttccattttgccagaataatctcagccccttatagaaatgtctgagcagaaaggcgggcttgtaaacagatgtgctttcacatcagtcaaactgctgggtcctacccttatttcaaaagagaactgcctttccttgataagacagctacgggtgttttctaattgtggtgtgagacttcccacgtgatgtttgggtgaattcttctcattgtgcagcttttaactctgcccttgaatctactgtttctgacttcaataaccacctactgccctcaatcccaactcagtacccaagagtgatcttaataattcctccaacatccccccaccccacccccagtcccagggccacataggtttgtcgtcattgtaacagatagcgtcatagccatcattgactgcaactttcaggactctcattactgctgatgctatgaacaccgtgcagggagtccacgccaggctgtttgcctttctgatgacaaacgtcacctcagacatgtgcagactctgttccagaagaccagaatggaagcagcaacttgaagaccctgtacagcccacatgtttccctgtgtgtattctcccgatgcaggcggcccaccccgttgtcagctatgacgtggcgggaaagctggtcttgacacagacctctcccaagaagaacacagaactgtgtcattgggtataatttacattataccatgttatttgccacttacataacactattcctggacagaaaagagtgtgagtttcttaaaatccttttcatcatggaattcgctcttctgcctcccctgggagctctgacctctgtggaatttgctctgtgtgccagccatcctggtgcctaagtaaccagggccactacatcctgccaaggaagttttacagtatcctgcagcgacactatagaatctgaaaccaactttaaaaacccactggttataaatgaaccgcaaagcccactaaattagaaaactttcttgttaaaaggttttagtcaatgtagcaaaaccatgagaaattaaataaaaagataattggatatgtaaattcataaggaacaaaagatacaagaagttaattattttatatattagtgacacaccagagcccattattaggaagcacaagaaaagtaatttttcaaaccagagtgatcttgcagtgcttggctgtgttcctatttgtttttgtttcttacagcagagtataagagatcaggagaggtccctggtcctaaaatgtataggcttgattcaatgacaagagaaagattagtcatagtgggctgaaggcatgccccttgtccaagctgcataaggaaaacgcagccttagaatggggacaaggatatgggatagagcaaaggaaacgaagtaagtgcttgtcctcaaaacacatacgtttccgagctgactcagaaacctagcatgtgctaaggatggcctggcgttgccagttttcaacagaacagcggtatccctgtggggcctgctgatgtggggagcaaaagtgtgtaatctatgtaactcagatagcaagacactattctgttctctcctaggccttttcttaaaaaataaaaataaaataaaaataaaaaacaataaagacttcccacatgccaaaaaaaaaaaaaaa

SEQ ID NO: 389 - DNA, 373 bp, Mus musculus
actaaatgtcaaatttctttattcttacaatgggcacattagagtttacttaaatacaaaatgtaccccttaagaaatttcattgacattttcatgccaattgctttttactcaaaatctttgcattaaaaaataaataaacatttaaattactgaactattctagatattaatcttaatacctctcataaaacttcagactttaaaacagaccttacacttggcccaaagatgggtccctggagggatgcaagccttttcactgcagaatgaacagttcaaacagggatgtccgtggcaagcttgtcccccagaagggatgacctgggactgtacaagagcagctgaaagtaggatctgcccagagtgggct

SEQ ID NO: 390 - DNA, 505 bp, Mus musculus
tttttttttttttttttaattttaaatttctatttaatcgggtctcttgggccctttttctggataaatattttcaagtattaaagtgactacaaatgagataaaagccactaaagtacttacaatccttaaggctttgaaccagttgggataatgtggtaagaggaaaagttcattgtgtaatgctatccctaaacctattattaatgtgactatggcttcattgagtctttcagaaaataggatggctgcccatgaaaacagaataggactcatactgctagctaaattaatgtagtctggtttggctggactactttctggcagaacaaaaccccatctgatccctcccaagaaagctaggaaaccggctccataagccatctgagtgaaagctaggacggggatataagactttgttattaccatgagaagtgggggagcagtaaaggggattaaccccgccagagttatatataaagctgggtttgggctatcgagtagg

SEQ ID NO: 391 - DNA, 2911 bp, Mus musculus
ccacgcgtccggagagaaagccggtgggactcggaagggaatcacggggccgcggggccgcccaggctgcagaggggacagaactagagcgagacagcgactgctgggggagtcccccccaactttccatgcagctgtggctctggggctgcccgggcttcctctgagagcagcacgcaggcctggcgaatggggttctgcgctcgccctgggaagtaaagggcaccctgccgactggaactcatctttaggccagtcctaggagcctggacatcggagcagccgccagccatcccttgtaggtccggcatccctggcagggggactatttttctgcatggaaataaagtcattgagcatccgtgcaatgaagaaaacccaggaaagttccttttcgaagtagttccaggaggtgaacgagatcggatgacagccaatcatgagagctatctcctcatggcgagcacccagaatgacatggaagactgggtgaagtccatccgccgagtcatatggggaccttttggaggaggtatttttggacagaaactggaagacacagtccgatatgaaaagaggtacgggaaccggctggcacccatgctggtggagcagtgtgtggacttcatccgacagcgggggctgaaggaagaaggcctcttccggctgccgggccaggcgaacctggtcaaggagctccaggatgcgttcgactgtggagagaagccctccttcgacagcaacaccgacgtccacactgtggcatccctgctgaaattgtatctccgagaacttccagagcccgtcgttccttatgcaaagtatgaagactttttgtcctgcgccacgctgctcagtaaggaggaagaagcaggtgttaaggagctaatgaaacaagtgaagagtttgcctgtggttaactacaaccttctgaagtacatttgcaggttcctggatgaagtgcagtcctattcaggagttaacaagatgagcgcacagaacttggcaactgtcttcggtcctaacatcctgcgcccaaaggtggaagatcccttgaccatcatggagggcactgtggtggtccagcagttaatgtcagtgatgattagtaagcatgatcgactcttccccaaagacacagaaccacaaagcaagccccaagacggcccgaacagcaataataacgatggtcataagaaagccaccatgggtcagttgcagaacaaagaaaacaataataccaaggagagccccgtcagaaggtgctcttgggacaagcctgaatccccccagagaagcagcgtggacaatggatcccccacagccctatcaggcagcaaaaccaacagcccaaggaacagtatccacaagctggatatttccaggagcccccctctcatggtcaaaaagaacccagccttcaacaagggcagtgggattgtcaccaacgggtcattcagcagcagcaatgcagaaggtgtcgagaagcctcaaactactcctaatgggagtttacaagccagaaggacctcttcactgaagagttctggtaccaaaatgggcactcacagtgtacagaatggcactgtccgcatgggtattctgaacactgacacactagggaattccttgaacggccggagcatgagttggctgcccaatggctatgtgaccctgagagataacaaacagaaggagccagcaggagagtcaggccagcacaacagactctccacctacgacaatgtccaccagcagttctcctcgatgagcctcgacgacaagcacagcgtggacagtgccacgtggtccacctcctcctgcgaaatctccctccctgagaactccaattcctgccgctcctctaccaccacgtgcccagagcaagacttctacgttgggaactttgaggaccctgttttagacggcccacctcaggatgatctttcccatcccggggactatgagaacaaaagtgaccgcaggagcgtagggggccgaagcagccgcgccacgagcagcagcgataacagcgagacattcgtgggcaacaccagcagcaaccacagtgcacttcacagtttagtttccagcctgaagcaggagatgaccaaacagaagatcgagtatgagtccaggataaaaagcttagaacagcggaatttgactttggaaacggaaatgctgagcctccatgacgaactggatcaagagaggaaaaagttcaccatgatagaaatcaagatgagaaacgctgagcgcgcaaaggaggatgcggagaaaaggaacgacatgctccagaaggagatggagcagttcttctccacatttggagacctgacagtggaacccaggagaagcgagagaggaaacacaatctggatccagtgagcctttctctgtcctggaccgctcgctccgcggaggactctggggactccggggcaaacagtgttggggaacaggtgtgggatcaggtggttggtctgtgtagagcttcatctggtgcaggaatctcatttccagacatcactatccatatctgcagtgtgtaccaaagttatatcatgctccataatgctactgtcaagtgttacaactggatatgtgtatagagagtagtttctaagatgtcaataagagtaagaagcatatatctcaatgattattttattgcaagtcctgtatttaaatgtcgaatcaatactttgttgcaatttagcttgcattcaagcttcaccccgtgcacttaacataagctatttttggcatcgtgttatcatctgcttattttatagatcaatatttttatttccccttttgtcgaggaaatggagataagaagagatataaatatataaatatatataagatgagttattaaagtcaaaagaataaaaaaaaaaaaaaa

SEQ ID NO: 392 - DNA, 2137 bp, Mus musculus
ccacgcgtccggcgggcctggcttgcctacctggcagctgcacccggtccttcacccagagctggttccatagctcaacatggtcccctggttcctcctgtctctgctgctacttgcgaggcctgtgcctggggtggcctactctgtgtcactcccggcctccttcctggaggatgtagccggcagcggggaagctgagggttcttcagcctcttccccgagcctgccgccgcctgggactccagccttcagtcccacaccggagagaccccagcccacagctctggacggccccgtgccacccaccaacctcctggaagggatcatggatttcttccggcagtacgtgatgctcatcgcggtggtgggctcgctgaccttcctcatcatgttcatagtctgcgccgccctcatcacgcgccagaagcacaaggccacagcctactacccatcctcgttccctgaaaagaagtatgtggaccagagagaccgggctgggggaccccgtaccttcagcgaggtccctgacagggcacctgacagccggcatgaagaaggcctggacacctcccatcagctccaggctgacattctggctgctacccagaacctccggtctccagctagagccctgccaggcaatggggagggagcaaagcctgtgaagggtgggtcggaggaggaggaggaagaggtgctcagcggtcaggaggaggcccaggaagccccagtatgtggggtcactgaagagaagctgggggtcccagaggagtcggtctcagcagaggctgaaggggttcctgccaccagtgagggccaaggggaagcagaagggtctttctccttagcccaggaatcccagggagcaactggtcctcctgaaagtccctgtgcctgcaacagagtctcccccagtgtctaacaggccccagaactgctgggacccgaatgttgggtccttgagggtcacctctttggtcaagaaaggcattcagctctaactgctccttgataccacgtggcttggccattgctggtgccaaggctgaccccgaactggcagagccgatgccctctggtgcaccccaggaaacatctccccaagttccagcgcccttaatgactcttgccaccctgggggcttcaccctaacgcaccacttctctggaaggggaaggccagacacatgccagttggggctgcatgaggcagtcctcagagcagaaggggaccaggccagaggccacctgtgacggggcaaactgcatctcggctgtggagaccagaggggctgttagatttggaagacatcaatgactgggcctgcggcgcagcccgtgtctggtaataccagggacggcagaggcgtttgcatcttcccatcacctgcaatgtcgctgtcactctgcccctgttcagtggacttgattagttaggaaacttctggaaggggccccctactttatatcacagagtttgccctagacaccccgtggaaacacaaactcaaaatcaagtggctttaggagccgctgtgcccctccacaagctgacatggctactctaagggttcctgctgggctggctttgctacgctttcctcaagctgctttcttattaccaggatgcctcacagctacaaagtccaatctcacagcacccgcactggaaaatactgttctccatttttttccaaggcaccctgctttatgattggctcagagttggaatatgggatgcagggcgtctggctctctcaagtgtcaagcaaccctggcttccgcatgtggggcgaggggagcgagcagaactcttctctgtcagtccacgaagtagactagaagccaacgggtgcctgggggcaactgacggtctggattctgacgcccagcctggagcaggggcctggcccatcctatgctcacacagtggtctggcagcctgagcccacacaactcctcagtccttgacaatgcttaggctctgttctgagggactccccacacctccattcagggctccccgagtcctcagctcttcggatgtggatatatgacacactagcataataaatcttgatctggcttgaaaaaaaaaaaaaaaaaaaaaaaaaaaaaaaaaaaaaaaaaaaaaaaaa

SEQ ID NO: 393 - DNA, 742 bp, Mus musculus
  modified_base (15)..(15): a, c, g, t, unknown or other
  modified_base (144)..(144): a, c, g, t, unknown or other
aaaatcaaccaggtntgcgtctctctctcttggtccttatttccccttagcatcttcacttctggggataattccctgccagttcctagctgatcacagctttccttaggatccaggaaggtctgtgttttctgagaatagtcntgctttgtgtgtctctctcccagtaaccccctagaggggttaggtgtatgtcttatggcatctaagttcacctgttcctgtcacttcctgttgtttgtagacattgtattgcaacacgaattctgcattgacattgttactggcgagaattactcaagggcttgttcttgaagatgtcaggggtaactgtaactgttgccacctgcatttttctggggaggttgtgagaaagccagtgagtgtcgtagaccagtggtgtgtcttgaaggctgctttgctccaagctgccaccaccatctgcgctggagcagtgaagaagaaagaatcttgaccactcaattacatggatttttatcagatctcagctaaactttcaaacagaagtatgaaagaaagacatacctggagaaaatggttgttaaagccatctgccattgtgtatagcaatgcctttgcaccctcccattagtgggaatagtcaaacaccaaatgtgacttcacatgtatatactttgactcctagctgctctctgtgtaatatttaaatttctatgtctattgtgacactctttttgaaaataaagtttatttgggaaat

SEQ ID NO: 394 - DNA, 1436 bp, Mus musculus
accgaaatatctcaaagtagctgggcctgcccccttttccccccctacctgttgtccttacccccaaactaccaccaccctggctccactccctcatgaccgcctggatcctccttcctgtcagcctgtcagccttctccatcaccggcatatggactgtgtatgccatggccgtgatgaaccgccacgtgtgcccagtggagaactggtcctacaatgaatcctgctctcctgaccctgctgaacaagggggccctaagagctgctgcaccctggatgatgttcctctcatcagcaagtgtggcacataccccccggagagctgcctcttcagcctcattggcaacatgggtgctgttatggtggccctcatctgcctccttcggtacgggcagctcctggaacagagccggcactcctggatcaataccactgcactcatcactggttgcaccaacgctgcaggcctcgtggtggtcggcaattttcaggtggaccatgccaagtctctacactacatcggaactggtgtggccttcactgctgggctgctctttgtgtgcctgcactgtgttctcttctaccatggggccaccacccccctggacatggctatggcctaccttcgaagtgtgctggctgtcatcgccttcatcaccctggtccttagtggagtcttcttcctccacgagagttctcagctccagcatggagctgctctgtgtgaatgggtgtttgtcctcgatatcctcattttctatggcaccttcagctatgagttcgggacaatctcctcagacacactggtggccgcactacagcctgccccgggcagggcctgtaagtcctctgggagcagcagcacctctacccacctcaactgtgctcccgagagtattgccatgatctgaggtctggagggtggctggcccagcctccaaaacacccgcaccctctaccttctttgcatttattttgtaccaaaaacaagttttagagagtattgttgggatctaggcttccttacttctggagaagtggccatccaacacccacctgtgccatagagggacagggcctccacagctgcctctgctgcttgtcctgtcccctcataccagagtagtattctgtgttaaaggtcacctgtcctcccttgcccagccagcccttcaggtgccttctactcccagtgccagagccagaccactggggccttctgctgcaggaattggggctggggtggcaggggctcacgagtctggatgatgggaggagcatgccttagcctaagggaaggcccacccagctgcacttgggttcttcactctgcccctcacttcctttagggcaaataacacagcagaaccacacgagtattttagtacttttttatatctattaaaagaattctaatttgcaaaaaaaaaaaaaaa

SEQ ID NO: 395 - DNA, 1738 bp, Mus musculus
gactcaggctcctctagagtgtgcagggctggaggagtcctgaggctgggtgtgcgcgttccgtgctcagccctgattggggagggccgccccaaattgctctccggcgcgcgggtgccccagccacagggcgcagcagcacactgccgtgcccttccctaggtgatctgatccactccaggcccccctgctcggtccccggaagtacgcgccagtcgtcctagagaaggagagagggaggggctgcactgagcctgaagagagagaggggctgcactgagcctgaagacatatccaggagctcttctccatgccacatgaagctgcccctcagccccagcacggaaccagtggccacggagcccttgggaatggctctgctcagcagcctcctggcagcctggtcttatatctcagaaaaccctgagcgagccgctctgtactttgtctctggagtgtgcattggcctgttcctgaccttggccgccttggtgatgaggatctcctgccacacggactgccggcgaggtccccggaggaggtgcttgcaggaccgcgagtgcagcgacagcagcgacagcgaggatggtagcgaggacacagcctctgacctctcggtgcgcagacaccgccgcttcgagaggactttgaataagaacgtgttcacctctgcagaggagctggagcgcgcacagcgcttggaggagcgcgaacgaatcatcagggagatctggatgaacgggcagcctgaggtgccgggcaccaggagcctgaaccgatactactagggctcagtgtgcaccccagaacctctgcagatcgccgggatgagagtgggttctgcaggcaaggacgatgtgcaagagctgaaaccagctctgttaatgtggctggagagtgcatagcgccagccagcctgctttcccaggagaatggggatttgctttagatccttgcctctggagaaatagacaacccaggcagtggcatctactctttcaggtcttgacagccacctgggcacaccagcccaatgctttcaggccttggaaaggtgctgaggaattcctctccaaccacgtgacagcgatgggacaagctgaaagtccttccgaagcgctcagaagtttgggcagacttatcctgtgctattattcctttataaaaggaaaaaaaaaatctcatagctggagagctggggcatcagggtgaccgtaacccagaaaatgtaattttctaaaggactccgtgaagaggaaatggttttgattgagatagcatgatccatgctaattatttaaagctaatttttaaaacagaaaaaaaaatcttgacaacctctgcattttaactgacacctcagggattaaaatcctatcttttagtctaggtcccacctcattcatgaagatgaatagaacttactgtattatgagatgtattggagacttaggatacatcaataacctcagaggataaagggttttattttttagtactctataaactatgtattgacatgtgtatttgaaaatgctgcataaaaatagaaaccgtgtgtcctttccttttggagagaaaagtctcatgacttcagagactcatgatatttaaataatattttgtttaaaaaaatagtttggatttccaagaatggaagccagagatgagaattaaatccaaaattagaatggtatcgaaaataaacattccatgaaaatcttaaaaaaaaaaaaaa

SEQ ID NO: 396 - DNA, 328 bp, Mus musculus
ttccatctttttcttcccatacctcggaatctgctcacccgtcaaggaagccccccagagttaatgggcggggaaggtactaggccactgccctcagcctccacagtcccggcacacttgcaactggaaagggaggtactccggccacatgtggatttccttctattgttttcttttgttttttctaatgtatttataaaagatcttttcccatttatcctgggaagtgtttttcaaactcagtgacaaggactttggtttttgtaagactgttgatgatatgaagcccttttgtaagaaaattaaaaattaagttaattccctctcc

SEQ ID NO: 397 - DNA, 864 bp, Mus musculus
tttcctgagggggcggcgagtccctccccgccgcccgctgcgctgaccctgcctctcctccccgcagcacaacgtcccaggccgccgcggtctccccagaacgatgccgctgcccgacaccatgttctgcgcgcagcagatccacatccccccggagctgccggacatcctcaagcagttcaccaaggctgccatccgtacgcagccggcggacgtgctgcagtggtcggcggggtatttttcagccctgtccagaggagacccacttcctgtaaaggacagaattgaaatgcctgtggccacacagaagactgacacaggcctgacccagggactcctgaaagtcctgcacaagcagtgtagccacaagcaatatgtggagttagcagatcttgagaagaagtggaaaaatttgtgcctgccagtagaaaagctcagaacgatcctggagctggatccatgtgaggacaaaatagagtggatcaagtttttagcgctcggatgcagctccctgggcaggaccctgaacacggccatgaagaacgtgtgtgagatcctcacctctgacccggagggcgggcctgctcgcatcccctttgaaacctttgcctatgtttaccagtacttgtctggactggacccagaactcccggccgtggagaccgagaactatcttaccagtttaagactgatgtcagaatctagaaagaatggcatgataggactttcggacttcttcgttgaaaaagataatatagaaagccttgaagagaaagctctggaagcagagcattgatacttgtttaatgttgaagccatgcttaggagaaaccttggcgccaaatacagcttgtcattacctaa

SEQ ID NO: 398 - DNA, 648 bp, Mus musculus
  modified_base (57)..(57): a, c, g, t, unknown or other
gagtgtctgaggacagctacagtgtactttaaataaataaataaataagtctaaaanaatgagtatgcaggagctggacatgtggaacacacttgtaattctagtgcttgagaggacaagaaaggagaagcataaatttgaggctagctaaaactaaaaagtgagtttcaaaacaaaaacctaaaacttgagtattcagaagacttatcatggcagttgacagttgatagtgagaggtgatgctgtatatgtaggaaaaaaggcaacacagcaagtaacgagacaaatgcagccttgacaaagagattagatttaagccaagaatagcctgtaatcccagcacttggtggaggcaggaggatcagtagttcaaggttgtctttggacacatagtgaattcaagaccagtttgtgctacataaaatcccatctcaagaaaacaaaggaaaacaagtgactaagttgggacaagtgaacaaacatcacgtgtgaccaagagacacagcgctgatggagtagttctgcctaaaatgtttacccaagcctaactgtagcggtatggccacacaagacccaaacaggaactgttgactaggcagctctgcctgcagaaagatgttatagcagcctggagattgttttaaatta

SEQ ID NO: 399 - DNA, 715 bp, Mus musculus
cccacgcgtccgatcagagaatacattcagctaataaaccttacaaatgtagtgaatgtgacaaatgctttactgaaaaatacagacttattattcatcagagaattcatacaggagagaaaccttacaaatgtagtgaatgtgacaagtactttacccgaaaaagcagtcttaatgtgcaccagagagttcatacaggagagaaaccttacaaatgtagtgaatgtgacaaatgcttttctcttaaaggtgatcttagaaaacatcagagaattcatacaggagaaagaaccttacagatgtgaatgtgacatgtgctttacctaaaaattcaattgtcatcttcattagagaactcatacaggagagaagccttacaaatgtagtgaatgtgacaaatgctttacccataaaagcagtcttaaaattcatcagagaattcatgcagaagaaaatcttaaaaatataatgaatgtgacaaatgctttagccaaaaacaatcacttatcagagaatgcatacagtagacaccttcacaaatgaagtgaatgagaaaaatccattcccaaagaaaaccaccttagaattcatcagagaatacatataggagaaggaacttattaatattgttaatgttcaaatccttcagctgtggttcaccactttaaaatacatcaagaatgcactcaggttaaaaacacaaatgaaaaaaagg

SEQ ID NO: 400 - DNA, 659 bp, Mus musculus
ggccgcgacaataaaagacgcgatcatccccgcgccacctgcagttggccatccgcaccgacgaggagctcaacaagctgctgggccgcgtgaccatcgcgcagggcggcgtcctgcccaacatccaggccgtgctactgcccaagaagaccgagagccaccacaaggccaagggcaagtgaggcccctaccggtcgttagtgcgacttttacagacaccaaaggctcttttcagagccacccacaacctcattagaaagcgctgtacactgagcctgtcgccagttactggccaggccagttctcctgactccttccgtgcattcctgcatccctgtgcggcgcttggggagctcaagggagaccaacggcttcatctgcggatggcctgcgggccgttggaggcgttcgagtttctccccaccactccgtgtcagacacaaggttgcagttaacgttcgtgtttggacattaaggggatacttaataatagaaattagtataaggttctggtttagatgctagtgtttctattgaaactgggttaaattgacatgttcaagtcttccagttaggacggggttttcaaaggtttctgaggggagacttggtatttcaaatctacttgtttatataaatgttctgttacaaggcgattt

SEQ ID NO: 401 - DNA, 3218 bp, Mus musculus
aatggaggagatcaaagttctccggagggtaaaggaggagaatgatcggagaggagggtttattcgcatatttcctacatcggagacatgggaaatatatgggtcctaccttgaacacaaaacctccatgaactacatgctggcaacacgcctattccaggacagaggaaaccccagaaggagcttgctgacaggaagagcacgagtgagcacggaaggagcaccagagctaaaggtggagcatgaactccaaggccaagctgcatgccgctctctatgagaggaagctactgtctctggaggtgcgaaaacgtagacgacggagtggcagattgagggcaatgaggccaaaatacccagtgattgcccaaccagctgaaatgaatattaaaaccgagacagagagtgaagaggaggaagaagttggattagacaatgacgatgaagagcaggaagcatcccaggaggagtctgcagggtctcttggagaaaatcaagccaagtacacaccttcattgactgttatagtagaaaattcgcccagagacaatgcaatgaaagttgccgagtggactaataaaggtgaaccgtgctgcaaaaatcaagctcaggagccagagtctaaattcaacctgatgcagatgctccaggacaatggcaatctaagcaaagtacaggcccggttagcattctctgcctatcttcagcatgtgcaaatccgtctgacaaaagacagtggtggtcagacactcagtcccagctgggctgccaaagaggatgaacagatggaactggtggttcgttttctcaagcgagcgtcaagtaacctccagcactcgctgaggatggtattgcctagtcggcggttggcacttctggagcgcaggagaatccttgcccaccagctaggagactttatcggtgtgtacaacaaggaaacagaacaaatggctgaaaagaaatcaaagaagaaacttgaagaagaggaagaagatggggtgaacgcagaaagctttcaggactttattcgacaagcaagtgaggctgaactggaggaggtgttgactttttatacccaaaaaaacaagtctgccagtgtcttcctggggactcactcgaaaagctctaagaacagcagtagttactctgatagtggggcaaaaggtgatcaccctgagaccatacaagaagtgaaaataaagcaacccaaacagcaacaggcaacagaaatccacgccgataaattatctcgatttaccacttcatcaggaaaagaggcgaaactagtgtataccaattgctcttctttctgcagtcctgctgctgttcttctgcagagactccccagctcccatctgtcgtccgtgatcacaacctctgccctctcggcaggccctggccaccatgcttctctatctcaaatccctccagctgtccccagcctgcctcaccagccagcactgctactgagccccgtccctgacaatgcccctccctccatacactctggaacccagaatgtaagccctgcggggctgccacgctgtcgatccggcagctacaccattggccccttttcttctttccaaagtgccgcacatatctatagccagaaactgtctcgtccctcctcagcaaaggcagcagggtcatgtcatccacacaagcatcattcaggaattgccaaaacacaaaaagagggtgaagatgtttcattaaacaggaggtacaaccaaagtctggttacggctgaactccagcggctcgcggagaagcaggcagccaggcagtattctccagccagtcacatcagtctcctcactcagcaggtgacaaacctgaatttggccagcagtgtcataaacagaagcagtgcatccaccccccctacccttcggcctgtcatcagtcctagtggcccaacgtggtctatacagccagacctccacgcttctgagacccactccagcccccctggaagcaggagcctccagacaggtggctttgcctgggagggcgaggtagagaacaacgcatacagcaagactacaggggtggtcccccagcacaagtaccaccccacagcaggcagctaccagctccactttgctctccagcaactcgagcaacaaaaacttcagtcccggcaacttctggaccagagtcgagcccggcaccaggcaatctttggcagccagacactacctaactccagtttatggacaatgaataatggtccaggctgcagaatttcaagtgccacaactggtggccagaatccaaacaccctgccacaaaaagtagtggcacctccaaattcatccaccttggtctccaagcctgcatccaatcacaagcaagtgctcagaaagccggcatcccagagggcttccaaagggtcctctgcagaagggcagctgaacggtctccagagcagccttaaccctgcagccttcatgcccatcaccaactccacaggatctttggaagctccccaagttattttcgcaagatccaaacccttacccacacagtctggagcccttgctacagttataggacagagaaaatcaaagtcggtgaagtcagggacaatttaagaccctgctcacactaacagatgaaccagagactccaagggaagaagaacctgctgtgcgctcctgggagcttgacggaggctaagcctccacggtgctgtgaggggtccatagtatttttttgctgcctctgagtccccaaggcctttaagcagaagtgaccagtagatgcttgccatcagccagcccagacttttaccaggacaacagggaacagaccctgtgggtttggatgagattggcagtggggactgtcgcctgatgcgtgtccccagcagaacacctttcagagtgtgcctttccctgccctccccctgccctgctaggtccctctgtctctcctcctgctgctcacagatggtataaaggaggctctttggctatttgcatctggcttttgctgcttttccagattgaaatattaagtttattttattttgtacaagcttcagatcccaacatcaaccaccaaacttgatcttccctttcccgagagtgtggggggtggggagccaacagcaccggctccccagagtggggaggcaagtaggcggctgccatggtccaggcgccatttggaattactgacttctaagattaataaagtaattcaacttt

SEQ ID NO: 402 - DNA, 644 bp, Mus musculus
gagagcagggagtaacgggactgtggtcgcgggcagccccagccacgcaccatgccctatctgctcatcagcactcagatccgtatggaggtgggccccaccatggtgggtgatgaacactcggatccggagctgatgcagcacctgggggcctccaagagaagtgtcttgggaaacaacttttacgaatactacgtcaacgaccctcctcgcatagtcctggacaagctggaatgcaagggcttccgagtgctgagcatgacaggggtgggccagacgctggtgtggtgtctgcacaaggaatgagctgcttgagctgacctgttcagagaccgccatgtgccctgcccacatccttgcatcactgtttgccctgcctatctctttccaaattgtcaactcccttgcccaatactggtgggctgtgaacagcctaagggacctcgctccagctggttgggcacagcaggctcctgccctggtgctttcagcttcccccagctaggcctgaccctggctcttgctgtaggccacatgctgaaggcaagccaacccgaggacgaggacagtccctggatcctacacagctaatccaagccaataaagggctctcacaagtggttgttcctcaaaaaaaaaaaaaa

SEQ ID NO: 403 - DNA, 324 bp, Mus musculus
tatccattctacatttacccccagtacccagctttaaaaatccatacaaaatcagaaagcaaagtttcttactatccatcgttttctacatcatttttttaatactccgtaaaacttttttttttttttttttacacctgagccgtggttttgatactgatattttcctatccccgaaacttttcttgctttcagggaaggtaagaaaatgtgttttttacatttgttacttatgtaacattcatattttcacagtttgatatctgtaacatactgtatgctttctacctgtaaatgccaacaatagaattaaaatatttattt

SEQ ID NO: 404 - DNA, 429 bp, Mus musculus
agaggtgaagaaaatgatcagttctttgaagaggtaaataaaagaccttattcttcagcaaacccaataccgtcttctagaatttaacagattgtacttttataatgcctttctccttaatgtagagattatgtactctcatttgatttgaaggtctagccttgccttctagacccactgcactatgagacaaatcatgttctttggaggcagtacttactctgatgttagtatgtaacgatctctggacatgtatacttctttgtttattcatgtcaatatactacagactttagaatgtttgtgtaaccaatacgtaatctaataaaatgcaccctagcaaattgttattgtttcactagacattataaaatgattaattcatggtgaaaatgtaaacaatgggcagaattgctaaaaaaaaagaag

SEQ ID NO: 405 - DNA, 429 bp, Mus musculus; identical to SEQ ID NO: 404

SEQ ID NO: 406 - DNA, 692 bp, Mus musculus
cccttgttcttaatggcccaagtgccaaagccaaatgtagccaggagtgctccttaatgcagaatgaacatcaacattggtgtcttgctgaaattgatagcttctactgtttcaggcatccactctgggtctcaaaactgtcttccccacgagaaggtaggagttcaagtaaaaaccgtaaattttagttacattttaaactctacttcagatcacagctgtgagtagccatcttgcagaatggagaaattttaggggtaattcaagtgaccttgtttttatcttgtgttcttgtgtttctgttgtgggaactcagatttgtagcacgaataaatgttcttttggtgaaagtaacagtcataaaattaagtttttgtattttagtggtaaaaagcagcctcataactttttgctagctttaaaatgttttaatattcaggggcaagatgataagtctgacagcaataaatacatagtgttaaaagagacaggaaacctgaatttcaaaattgttggcaagcatttagaactggtagtttgggaaatgtaaaatactttttaaacaaataatttgggaatgtggcagagaaaagattttgaaattaaaatttcctgtattctagattttataatatcaacattaaatatttttcttggttcttaataacattaataaaagcagcccacttaaa

SEQ ID NO: 407 - DNA, 479 bp, Mus musculus
cggcacgagggcgcagagaggagagggagccggagatgccagacgcttggttctgaggagtgatttgcaacgcaatggagcgaggaagggatcgcttacacttgagaagaactactgaacagcacgtgcccgaggtcgaggtccaggtcaaacgtcgaaggacagcctcactgagcaaccaagagtgtcacttgtacccacgacgttctcagcaacagcaagttcctgtggtggatttccaggcagaactaagacaggcattcttagctgagacaccaagaggtggttaaagcagtattgcaacttcaaggtggtggaattcaaggaaaacaggacccatcctctgtctgtaaactttggtcaagcttacattgtttgttaatagccctgcatcgaacctttatttatatcccttccccgagtattaaggatcttgaaattttagtgttgacaacggctattgtggaacagcaatcatg

SEQ ID NO: 408 - DNA, 2250 bp, Mus musculus
gctctccagacctcttctgcgcagcctggtacttgctactcgcttttccctcttcgccctccggtccgccaccatcctctccacgacgtgctgtcctgcgtccgcaaccatgtgccgcaccctagccaccttccccaacacctgcctggagagagccaaagagttcaagacgcggctgggaatctttcttcataaatcagagctgagctccgatactgggggtattagcaaattcgagtgggccagtaagcataacaaagagagaagcttctcagaagatgtactgggatggagagagtctttcgatttgctgctgaacagtaaaaatggggtggctgccttccatgccttcctaaagacggaattcagtgaggagaacctggagttctggttggcctgcgaggagttcaagaagatccgatcagccaccaaactggcgtccagggctcaccacatctttgacgagtacatccgcagcgaagcccctaaagaggtgaacatagatcacgagacccgagaactgaccaagacaaacctacaagctgccactaccagttgcttcgatgtggctcaggggaagacccgcacattgatggagaaggactcctatccgcgcttcctcaagtcaccagcttatcgcgacctggctgcccaagcctcggccacttccacctctgcacccagcggcagcccagctgagccttcacacacttgagcctccgcagcaacctagaagccatcgggaagagaggtggagtcgcccgtccctaaagcagctgccctgtgtgggaggcagatcctgtgcagcaagtgcaagaggatagtggaaggacagacggacatccatccccgcagcttgagtgcgaagaacccctctcctccagatactgtggtgggccagtgtaggagagactcctcatttccaggacctgtgactgagggctgacgacaaggctgcgccgggtgctctggggggaagggtggcccagaacttatactttttaccagggcacacacaaagggatgctgggtggttgggaaccatgagaacaggagccagagagcagttatttaagggccagacagtcggctttggtccccgtcttgatttcctcactcctggactgggcctagaaaaggctgtgtgtgtggaaccttcatttcctgccccttgccttcccagggacacccagggcccccgagctgaggcttcttaatattcctgtgctcattcttgccgtctcacagaggtcaatgagtctgtctgattcttggcccagatgagatttctatacctcaaaaaaccggcctgtgagcccctttccgggtcaatgatgaatcctgcaaaagaagccattctgcttgtgaacagggctaactgagaagtcttactgggccctgcgctccttggaagatggggtctaaggagggaggtgggaggaaggagaacttccggcacaagggccagcaatcatgtccaagcaggtgagtaagggagagaagtcattgaaaaatccatctaggagcccaaaagactagctgaagtcaaaccagttctctttgtgggtatgaaaatggggaaaagtgtctcctacccctcaccctggtggaaggggagccttgtgcttctttcctgttgacatgagatgcccactgtagttaggggagaagcccgtcaaggaccaagaaagctctggaacagaagttagctcagccaagggagtattgcagatgtgcggggagggctgcctggaaggatggggccgggggaaaccaacttgcctgcctatcacttctgagtcttaccgaacaaactttccaagttgggacttccagcaccagccaccgagacggagacctaggttgtttccctctgcacttgaggtttctccgggagagaactcttttaagtataatattgtgttctgttgtgttgtgccgattgtctcgctgctattgttatttattgtggtttgtttgcctgtactgaagagcctcagctggagctgctgcctgatcacgcctcctccctaccagactctacctctgcaagccttgggaatcactgagggctgggggggggggggaacgggacacgggactccccactgtgttaatatttatttattgttaacaaagggagctgggttcctttatcagcagtgtatgtgatcactgtttttctgtttgagcatgttatattcttgtaaaaaaacctgaaaataaaactcaaaaataatatcccaaaaa

SEQ ID NO: 409 - DNA, 287 bp, Mus musculus
taaattaactattacttggttatgggtgccaagaaaccatttaccgcttaagtgccccttttaataccttaaaagtgcattcatgaaatgttggtttttatgtaaacctcataatttaaattttgagatttaaattaagcagtttaccatttttaataccacctaagaatatattgatcaaatctgggaagtcagatgaactttagaatgaaggttcacagttttatttcacatttatgtctttagccttgatttgaatgcttcctgggtgaattcaaatctaagcg

SEQ ID NO: 410 - DNA, 287 bp, Mus musculus; identical to SEQ ID NO: 409

SEQ ID NO: 411 - DNA, 587 bp, Mus musculus
  modified_base (384)..(384): a, c, g, t, unknown or other
  modified_base (394)..(394): a, c, g, t, unknown or other
  modified_base (419)..(419): a, c, g, t, unknown or other
  modified_base (425)..(425): a, c, g, t, unknown or other
  modified_base (473)..(473): a, c, g, t, unknown or other
  modified_base (479)..(479): a, c, g, t, unknown or other
  modified_base (493)..(493): a, c, g, t, unknown or other
  modified_base (528)..(529): a, c, g, t, unknown or other
  modified_base (546)..(546): a, c, g, t, unknown or other
  modified_base (581)..(581): a, c, g, t, unknown or other
ctatacgaagggctgtttatctctttaactcagcaaaacctggaatccacaatctgcaaaagcccgcagtgcccaggaactttttagcttgttttgcactggtcggtggaggagtatgaaacacagtctctttttttagctgctttaacaggtaggccaccggactcttttaaggactcagcttctgtattagcaccccttttgttatctcttaaacacattgatctttagccaaaagcttttttttgttgccaggtactatctaggtttttttaattttcctgacttttgtgaccagcattttatttctcttatctctttgtctcacagcacagctctgattctgactctggtctctggtctttgtcaggcctcatggtttcnttaaactccntccttcttggtctggactccttaanttaacnggttttttttttttttttaaaaaaattttttccatttcaggaggtaancctttnccccatttttaagnaccctccctcctaaatccccctttttaaacccccnnaattttttaaacttccncctttcaactgggttaaaccccaatcccctttccnggggtc

SEQ ID NO: 412 - DNA, 3723 bp, Mus musculus; identical to SEQ ID NO: 283

SEQ ID NO: 413 - DNA, 515 bp, Mus musculus
gcggccgcacaggggacgttacggattcggctgcctggataaaagatccccttggtcagccaatgaggaaggatgcagggggcctgagctcaggacttgcacaactgagtgtgaaagtggcacatcatctgcctgcaggtccacagaaggctggagagctggaggggatgtgccaatcacggcagggcagaagggaagaacccagtcctggtctgcaaacctgggggcagggggtgcaaacctgcctgccccttcctcaagaccccatggaattgacagatgatgacatttctaagagttttagtggccagtcctctcaacaatatcaggagagaatgaagatccaagcagtagaaagttccagaatgccctcaaattaacatctcaaagataagtatttgtatcccagccccccacccagagaactgtgggaaagtttgggggtgggcactggtcacctgaggtcatctgggtgggggttctctcttttttttctacgaagaaagcttgcctta

SEQ ID NO: 414 - DNA, 464 bp, Mus musculus
tttttttttttttttttagacttaatttctttattagtttttctgcacagttaactttctatatcaaggatttttgttttgcattttgtaatctcaaagtctctttatcagccaccaaacagaatacacaaaattaggctcttaactttgtacagagaggaaaataatgaactccattaaaagttcatcttgaccaaagagaagacaactaccaatgggaaaccacatacaggaaggaggacctgatatacatacatatatatatatatataatgtataggtatttatagatatcttaagaacacagcaaaaagatgtccaatacttggagtgctatctacagtaagggattagttctaccacctctaaacagtcacattcagtattcacggaagcacgtgagtgaactgaaccggggataggaaacactccactggactccagagcagtctataaatggctta

SEQ ID NO: 415 - DNA, 243 bp, Mus musculus
accactgacaggaaagctttatttactacttttggagtctgggggggcccccttcgcacatgcagagttcacccattcagggcagccagctggatttctgacttgcttggctgggccaaaaaaccttttacagggacaaaatataaaagcacaggggacatccggccactgcgaagtccgggaagcccatttgttttgacagaaaaaatatagtttgttttttttttaatagatgaattctca

SEQ ID NO: 416 - DNA, 440 bp, Mus musculus
agaggggctttaaaaaaaacaacaacaacaacttttcccttttacatttttatgcatagccaggcctaactcccgggtaaagccagagagaaggaaacaacccctgaccaaccacaggcccttgctggttatgttaggaaacctaattggttcctcccaacacaggcacatctccttcatttggaaatgcccagggctggagagtgaggaggaagaatatggaaacacacgcgtttccctggagaagcttgaggacattgatcacaagagatttccaactttcctccccccccccctagactccacacactgagggccctgctaggtcatgcacgaagaaggagaagaaataaatcaacatagtttccgatgcttagcgcttataagcactaagcaaatgcatcctgtgagtgagacagatattaaaggcataaacaact

SEQ ID NO: 417 - DNA, 556 bp, Mus musculus
  modified_base (501)..(501): a, c, g, t, unknown or other
cctttttttttttttttcaggagtccatctgcctttattacatacatgaaatataaaaacaaagtcacaaggcaatatatatatatatatatatattttttttttttttgggagtccacaggacctaagggaaaaataggctccggatgtgaatctaaggtttcagcactgtggttcctggtttgtaagttcaagtacagtagaaactgtctgcagcagggctatgcctggataaagaagatggaagacgatggaaaggagcaagctggtgaactatcacatagtctgcgttaggaaactggtacatgtactgttaatacaagaaggaagaaaactggtccaatattcatgtttaaatactaaacaaaaaatagagcaaattctgtgcttacaataattgtcgaagtgtgtacaagtgcctcacaaataaatgacattttcgacatttaaaatctacttcccctctacgcaaacatttttctacattttttcttttaaagnctctctctctctctctctctctctctctctctctctctcatttcattatggccag

SEQ ID NO: 418 - DNA, 927 bp, Mus musculus
cgatggcggagaagacgcaaaagagtgtgaagattgctcccggagcagtagtgtgtgtagaaagcgaaatcagaggagatgtaaccataggcccgaggacggtgatccaccctaaagcacgaattatcgcggaggccgggccaataatcatcggtgaaggaaacctgatagaagagcaggccctcatcataaatgctcatccggataacatcatcccagatactgaagatacagagcccaaacctatgattattggcaccaacaacgtatttgaagtgggctgtcattcccaagccatgaaaatgggagacaataatgtcattgagtcaaaagcctacgtgggcaggaatgtcatcctgaccagcggctgcatcattggggcttgctgcagcctcaacacctttgaagccatccctgagaacacggtgatctacggcgcggactgcctgcggcgggtacagacagagcggccacagccccagactttacaactggatttcctgatgaagatcttgcccaattaccaccacctgaagaagacgatgaaaggcagctccaccccagttaagaactgagaagatgtcagtggtgctcggttctgccagctgtcagcgggcccggctgttagcaccgtgctgactttccattggagacttgagttggagagaggtgggtcctattgtaacgaccgctataatttatatggactatattgtctccctgtccttgttctggtaatgtacagactcagtttttcttatgttatacaaaatattagccatgcatttattatgtaaaagactacccatgataacatgccatattatgtgtttatattctaatgtaaccatataccataactaaataaaagtttggctacttgcactaatcttccsaaaaaaaaaaaaaaaaaaaaaaaaaaaaaaa

SEQ ID NO: 419 - DNA, 2084 bp, Mus musculus
cgaaaggcaagcagaacttccaagtcacgctatttattgaaggccgaagatgctggtacccatagaagagtgaaccgtgcctcagtcagaagacgttcctgtttgcaggccacacacccaggagaggcaggatgggcaccgctggaaaagttattaagtgcaaagcggctgtcctatggggagtgaaccagcctttctccattgaggaaatcgaggtggccccaccaaaggctaaggaagtccgtgttaagattttggccacaggaatctgtcgcacagatgaccatataataaaaggatcgatggtgtctaagtttccagtgattgtgggacatgaagcagttggggttgtggagagtgttggagaaggggtcactacagtgagaccaggtgacaaagtcatccccctctttctaccacagtgtagagaatgcaacgcctgcctgaacccagagggcaatctctgcattaggagcgatctgacaggccgtggagtattggctgatggcactaccagattcacctgcaagggcaaaccggtccagcacttcatgaacaccagcaccttcactgagtacacggtgctggacgaatcctccgtagcgaaggttgacggtgcggctccgcctgagaaagcctgcttgatcggctgtggattttccacgggttatggagctgctgttaaaactgccaaggtcacccctggctccacttgtgttgtctttggcctgggaggagttggcctgtcggtcatcatgggctgtaaagcagctggtgcctccaggatcattggaatcgacatcaacaaagacaaattccagaaagctctggccgtaggtgccacagagtgtatcagtcccaaggactctaccaagcccatcagtgaggtgctatccgacatgacaggcaacaccatacagtatacttttgaagttattgggcgtcttgagaccatggttgatgccctctcatcttgccatatgaactatgggaccagtgtggtggttggtgctcctccgtcagccaagatgctcacctatgacccaatgctgctcttcactgggcgtacgtggaagggctgcgtctttggagggtggaagagcagagatgatgtacctaaactggtgactgagttcctggaaaagaagtttgacctggaccagttgataacccacaccttgccttttaataacatcaatgaaggatttgaattgctgtattcggggaaaagcattcggactgtcctgacattttgagttccagagacctgggtgttctgagctgggctaccgtgacctgaagccttgctcctgacagtgttctctgagatcacaagtctgtctcagaagcacacagaagcagagctggggaaagacagagaagctttctagagtctggcaaacctttatctgcttagtttaccgagtgcctaggcttcgcagagaactcagcagtaacaataaatgttctaatttgtgttttccaaggctataattctatattttataagcatgtacttagggttctatttgttgaaagagggattgttttcagaattttacagttgttatggcttaaaacagatgtggcatgtagagatgtagaaaatgaatttttcaagaaatgaccatcaaaaccaccagagctctcattctgtttttttttaacagaaacacttttaaaacatgttatgaattaacttgaattagattgtgaaatagcacacataacttgattagattaagaaagaaattgggaaatttaagggaagggcacatttttcaatgattaacttggagaattatcattatataactttgtgacatgggaaaagcacagccatgtctggagatgttagtcagtgtttatcaatataagacaagacatttttagaatagcaattaaatataaccgcattgtgatatttaccatactaagtttaataaagtcgaattacaagcccttaagtacatagtaataactacatttaacatggggattatttttttatttgctgtaattgcaccagcatctgtcagtggagatgtacataaatttactatgcattaaaatttcattatggt

SEQ ID NO: 420 - DNA, 464 bp, Mus musculus
tccttttgacacggttcgccgtcgtatgatgatgcagtctggacgcaaaggaactgatatcatgtacacaggcacgcttgactgctggcggaagatcgcgcgcgatgaagggagcaaggcttttttcaagggcgcatggtccaacgttctcagaggcatgggtggcgcctttgtgcttgtcttgtatgatgagatcaagaaatacacataattatgtcctaggtgttctccccgagaacaggcatgttgtataatataccatatcttgaacattctggacagattctctgggcttgtctgttttatcagtggcaactatttaccagttgaaaagtgggaagcaataatattcatctgaccagttttctcttaaagccatttccataatgacaataatgatgggactccattatatttttatttcagtcactctcgataatagaaattgaagaaataaaataccc

SEQ ID NO: 421 - DNA, 2907 bp, Mus musculus
gcgcaccaccacccgcctgcgccgccgccagccgctggcccgcgactgccctcggaggagctggtccagacaagatgtgaaatggagaagtatctgacccctcagctccctccagttccgataatttcagagcataaaaagtatagacgagacagtgcctcagtggtagaccagttcttcactgacactgaaggcataccttacagcatcaacatgaacgtcttcctccctgacatcactcacctgagaactggcctctacaaatcccagagaccatgcgtaacacagatcaagacagaacctgttaccattttcagccaccagagcgagtcgacggcccctcctcctcctccggcccccacccaggctctccccgagttcactagtatcttcagctcccaccagaccacagcgccaccacaggaggtgaacaatatcttcatcaaacaagaacttcctataccagatcttcatctctctgtcccttcccagcagggccacctgtaccagctgttgaatacaccggatctagacatgcccagttcgacaaaccagacggcagtaatggacacccttaatgtttctatggcaggccttaacccacacccctctgctgttccacagacgtcaatgaaacagttccagggcatgcccccttgcacgtacaccatgccaagtcagtttcttccacagcaggccacctactttcccccgtcaccaccaagctcagagcctggaagtcccgatagacaagctgagatgctgcagaatctcaccccacctccgtcctatgccgctacaattgcttccaaactggcgattcacaacccaaatttacctgccactctgccagttaattcgccaactctcccacctgtcagatacaacagaaggagtaacccggatctggagaagcgacgtatccacttctgcgattataatggttgcacaaaagtttatacaaagtcgtctcacttaaaagctcacctgaggactcatacgggtaggtgatcttcttgctaattctgcgagttctgtaaacagtgtaagcggcattcatccttttaaaaagccaatacgtgtttgatctcttctttcttctgtcaacttttattttttaatggcctaccttttcagcaagggcttgcttggctcaaaattccgttccccaagaaagtctggttccgggaaggctgaggtttccccagtgagaccttgccctgtcaccctcacgtagaattaatgaccctcaaaacgtaaacggcagtgtttactaatggattttaaaactttaatggcaatgctattcctgtcttgaaagaaggaagaaaaccctccttggtaaatcgtcgttgcttcaataaggcccctttttaagctaaaaacttttcccgtcaccatgttaggcaccggtgcttagcacattatcttcagtttcaccagtggcttcaaatatttgtgttttcacctttttgccatgtctgagaagtaggcctaagatctgcagagggtgaaagagctcggccagggtgagggcaggatttgaagcattcctctccagccaaccccgggccttggcttgtctgagaggcctagtccatccttaagtcttccatttcattttcttctgcagcttgcttttaagttcagtctctaattatattttgatgtgttttgttaaattcacagcaacccccttgtaggagctattcattttgaagccgcccttgtatcagaaacacgtttacaatgacgttcagtagcctactttattagagggatccacctacccataatatcttcaagtgtctggatggttactattataattttcttaaagaatagccctgaaggaaaagacagatataaaagtgactgcattccccccctcaataaatacaccctccttacctaaagttcaaagaataagtttgctaataaaagcagtgacctagcaaaatgtattattccatcattgctatggaaaccagagtattcaacagctcctttgaatgggttgttggattagtgtgaggacttgcctctccctaggctggaggttactatggaaattgagttttgataaatgaagtagttatctctaaccactgcattaaaaagtaaaagcttttggacaaaggtcagtggcgaagcagagctctgtgagagtatggtttcagacattgtgtatgcgtgttaggagggagcagtgcttggttatctgaatgcctaacacttcctaaaacccgggtggtagctgtgagctttccaagaatggcttttgaaagaaaaggcatctctcagtttatctgtgataggagtgaaattatttgggcctgaggttgggttgggttttttgtgggcaggtaagcatgaacagaataaatccaaagatgattcaaactccagtctaaaacctcccaaatagagttgacaggtgccagaagagtccatatagaaacactaaagcaacctactaaaatgtccttttgtagactagtgttagggaaacactgaacatggggttttgagctttggatcaagaggagaaacagaagtagtttaggaacatttgagctgttgtttcttctctctcatcagaagtccttgaaactggagataggaaagaggaaaggtattttttgaggttaaagtccccataataaaagaagtgtgcaattgcatataccgacgtaatcaagtgcttattgcaggcacatcgtcaggctatatctaaatagcctttccaccctgtcagggtttactgctctgaatgcttgtacctgggatcctggaacttgacctgctggcagagaaatttaatagtgggtcgtctgaacaatgcccacactaataaaaaaaaaaaaaaaaaaaaaaaaaaaaaaaaaaaaaaaaaaaaaaaaaaaa

SEQ ID NO: 422 - DNA, 1662 bp, Mus musculus
gagctgcgcgcctcccgcctgcagcctctgctccgcgggtcggccgccagggtcccgcgctgctccggagcggcgggcgctgtgcacgctctgccgccgacagaaccggaccggagccgcgatgccgggcacctcgaggcattcgggtcgcgatgcgggctcagccctgctctcgctgcatcaggaagaccaagagaatgtcaaccccgaaaaactggcgccagcccagcagccgcgggcgcaggcggtgctgaaggccgggaacgtgcgtggacccgcgccgcagcagaagctcaagactcgacgggttgctcctcttaaggaccttcctataaacgatgagcatgtcactgctggtccttcatggaaagcagtcagtaaacagcctgccttcaccattcatgtggatgaagcagaagagactcagaagaggccagctgagcttaaagaaacagagtgtgaagatgccctggcttttaatgcagctgtctctttacccgcagcaagaaaaccactgacacctcttgactatccaatggatggcagttttgaatcaccacatgctatggatatgtctattgtcttagaagacaagccagtgaacgttaatgaagtacctgactatcaagaagacattcacacgtaccttagggaaatggaggttaaatgtaaacctaaagtgggttacatgaagaggcaaccagacatcactaacagcatgagggcgatccttgtggactggctggttgaggtgggagaagaatataaactacagaatgagaccctgcatttggctgtgaactacattgatagattcctctcctccatgtctgtgttaagagggaagcttcagcttgtaggcacggctgctatgctgctagcttcgaagtttgaagaaatataccccccagaagtagcagagtttgtgtatattacagacgatacctattccaagaagcaggttctgagaatggagcacctagtattgaaagtccttgcttttgacttggctgcaccaacagtaaatcagttccttacccagtacttcctgcacctgcagcctgcaaactgtaaggttgaaagcttagcaatgtttttgggagaactgagtttgatagatgctgacccgtaccttaagtacctgccttcactcattgctggagctgccttccacttggctctctacacagtcacaggacagagctggcctgagtcattggcacaacagactggatataccctggagagtcttaagccttgtcttgtggaccttcaccagacctacctcaaaccgccacaacatgcccaacagtcaatacgggaaaagtacaagcattcaaaatatcacagtgtttctcttctcaacccaccagagacactaagtgtgtgagtgaaagactgccggctttgtttgaaacaggagtcgctcggagtccatgctgtacagtttttatgtcgggttttagtttcacaatcacttctgaatgtagatggtatagccacagacaaattatggtatccattgcttttaaaatggttttaatttgtatatcttttgtacatgtgtctatttggataattttaattggctaacattggtgctgccaactgtcaagatattgagaataaactgatttggaaatcttaaaaaaaaaaaaaaaa

SEQ ID NO: 423 - DNA, 1510 bp, Mus musculus
cagggtgacaccccaggattacataaatttacaggggctgccgaattggtcgaacaagcccgtggaacctggaagccagagaacaccatcgctgtaaaggaaagaaactgaagcttttctcggagcctatctgggctgctcaaactttcagaatctaccgaccatggagcgtgtgcttggcttgttgctgttgcttctggtgcacgcctctcccgccccaccagagccctgcgagctagacgaggaaagttgttcctgcaacttctcagatccgaagccagattggtccagcgctttcaattgtttgggggcggcagatgtggaattgtacggcggcggccgcagcctggaataccttctaaagcgtgtggacacggaagcagatctggggcagttcactgatattatcaagtctctgtccttaaagcggcttacggtgcgggccgcgcggattcctagtcggattctattcggagccctgcgtgtgctcgggatttccggcctccaggaactgactcttgaaaatctcgaggtaaccggcaccgcgccgccaccgcttctggaagccaccggacccgatctcaacatcttgaacctccgcaacgtgtcgtgggcaacaagggatgcctggctcgcagaactgcagcagtggctaaagcctggactcaaggtactgagtattgcccaagcacactcactcaacttttcctgcgaacaggtccgcgtcttccctgccctctccaccttagacctgtctgacaatcctgaattgggcgagagaggactgatctcagccctctgtcccctcaagttcccgaccctccaagttttagcgctgcgtaacgcggggatggagacgcccagcggcgtgtgctctgcgctggccgcagcaagggtacagctgcaaggactagaccttagtcacaattcactgcgggatgctgcaggcgctccgagttgtgactggcccagtcagctaaactcgctcaatctgtctttcactgggctgaagcaggtacctaaagggctgccagccaagctcagcgtgctggatctcagttacaacaggctggataggaaccctagcccagatgagctgccccaagtggggaacctgtcacttaaaggaaatccctttttggactctgaatcccactcggagaagtttaactctggcgtagtcaccgccggagctccatcatcccaagcagtggccttgtcaggaactctggctttgctcctaggagatcgcctctttgtttaaggaacatttgcatcctcctggtttctgagggtcctcgtcaacgaatcctctgctttaaatttattaaaatcttaatccacgatgtaaggaaagaaaggcagtcaagatggttcagtgggtaaaagccagcaaacttgacccctgattttaaccctcaggatccacacggaaggggaaaactcactcctgaaagttgtccatctgtgctcacaaataaatattttttaaaataaaaaaaaaaaaaaa

SEQ ID NO: 424 - DNA, 2124 bp, Mus musculus
cagagaagaagcaaagctgaacctcgggccacgtagatgaattttaacccgaagaatcgcttctgttcctcagatcccttgtcattctgtggagtcttcgcttacgtccagtcctgcaggaggtttttttgttttttttttgttttttttttgtttttttaatctcacaaaattcaagtcggcctttaaacttaagatcggtttcttctggtcaagagtgtgaaactgcgtggtccggatcaagccagtgttctcttcgttccacctttgaagtcctgagcttgcctgacgtctgtaagttttcgccctgagcaactgcaatgtaacattccaagaggttaaacccttcatcctaccgggatgctcctccacccgggctcagccgggcactggaaagggtggagagactggagttgttgaatatctggacagtgttcttctcctagatagccccacctccctcggtgaagactctgaagtcatgtctacaggacctatcccacctgcaagtgaagagggaagttttgtttcagcacccagttttaggtccaaacaaaggaagatattacacctacttttggagagaaacacttcttttaccatccgttcagatttccctgaatctccgaaagacaaactccacgactcggcaaacctaagcattctgtcgggaggaaccccaaaatgttgccttgacctttcgaatcttagcagtggagagatgtctgcctctccgcttaccacttctgctgaccttgaggacaatggttccttggattcatctggacctctggatagacagttaactggcaaggattttcaccaggaccttatgaaaggtatcccagtacagcttctttgtagtactccgaatgctatgaatcatggccacagaaagaagattgcaaagcgtagcacatctgcacataaagaaaatgcagcgttcctgcttctctccctccagctgattgacgcgggtccttcttgtgcagataaacaccagtttaaaggcattggaatgggaggcactaggaccccaaggtttcgaaaaatgcctggaggtcctctgacttctcctctgtgtgagctggaaatgaagcatctgggcagtcccattactacggttcctaagctgagtcaaaatgtaaagctagaagaccaagaaaggatttcagaagacccaatggagtgttccctgggagaccaggacgccaagggcttaagtctaaggaagatggtcccactctgtgacatgaacgccattcagatggaggaggaagagtctggctcagagcttctgattggtgatttctcaaaggtgtgtgtgctgccaacggtgccagggaaacacccggatctgaagtatatcagcccagacacagtggctgctttgctgtctggaaagttccagagtgtgatcgagaggttttatatcattgattgtcgctatccgtatgagtacctgggaggccacatcctgggagccttaaacctgcacagtcagaaggaactgcatgagttctttctgaggaagcctgttgttcctctggatatccagaaaagagtcatcattgtgttcctctgtgaattctcctccgagagaggccctcgaatgtgccgttctctgagagaaaaagacagggctctgaaccagtatccggcattatattaccctgagctatatatcctcaaagggggctacagagatttctttccagagtatatggagctgtgtgacccacagagctactgtcccatgcttcaccaggaccaccaggctgagctgctgagctggcgaagccagagcaaggcccaggaaggggagcggcagctgcagggacagattgccctcctggtgaagggtgcgagcccacaatagtgactatgacggtggtcagtgaatacactacagaccctggacagaaggagtcatcttccatgtcgctaatcccgtgattatgtctgcaaacatgggcagagccaggcaggctgtaaataaatgcctttcgtcctagcactaaggaggcaaaggcaggaggatctttgagtttgaggccagcctggtctacatgtgaccttgtctcaaaaacaaaacaaacaaaataaaacaaaacccattaaacc

SEQ ID NO: 425 - DNA, 657 bp, Mus musculus
ttttttttttttttttatacaaacaattgtatatttttaatttcaaaatgtaaagataaccacaactgtatgtttccctcacaacaatagaatcaaaagcaggaaaatataaaggcagtagctttacatttcaatatcagcaaatcttaagtcaattgttaaatggatgctaggattaggagataatgtgtaacaatgaactcataaagcagtaagcagatacatggataccttccccatcccagaatgacaaacactccacctacggcacaaacagccaaagcaagagcaacacaaaagtttcactgcacacaggaaaaccatgagaatcctcccttccccattacactctactagcaagccaacccttttcatagtgtgtcatgcaattacaattaacaatcagtaagagtaaaatgatgtttagtgatgctttctccatctagaactaacatctagaagcgttaaaactcttattttctccaagaagacatcattcttaatgccagaccacattcccttttgcaataattcaaaccaaaagctctgagcatcaggcaactcaagcagcacaaagttaaacaagtctaacgtgactactgatcacaaaaaatattctaattgcattcatgatcaaaaatgaatacacagtttgct

SEQ ID NO: 426 - DNA, 630 bp, Mus musculus
cttttaaaaaaattccaaaattcaagggtttcaattttcccggggcagtttcaggggttcaggtttttccttccagcacaccatgcaggtaaatcaattggtggtggggtaaagatagacaccctttttcaccctcagcattgggtgccatttcctgtgtgaagcctagcagtattgacctaccctggaagtatgccagaccagaaaggtgagacactcttggaaaaagacacttacaacccttggaaatgcaggaagcctcaggtcagtcaccagattgactggaaaagacctgaaccctgagaatgtgctgaaaggagcctccagtttctggcttccacttgccaatgttggcatatgtccccaaggcctcttagaggctctgatctgtcacccatattcatgaagtcagctatgttaaagacaactcatgcccaggaaggtggactagaatagtcatagaaatgacttgtttagatcccatgagctagctatataagctgcattttaaaccattgcattgcattgagatcttgtaacctgttctgtaatgtattttgacattgctggggaaaaaaacaaacaaaaaaaaaacatttttcttttattttactattgaaaccaaggagg

SEQ ID NO: 427 - DNA, 2728 bp, Mus musculus
agtcgggagtgtaccaggctctgggaaaaccagggctcccagccgagatcgtttacctgcaagccacgacccggccggcagctaccatggcgcgcctactgtgcttcgtgctcttgtgcgggatcgcggatttcaccagtggtttgagcatcactacacccgaacagaggatcgaaaaagccaaaggggaaactgcgtatctaccatgcaagtttactctcagtcccgaagaccagggaccactggacattgaatggctgatatccccgtctgataaccagatagtggatcaagtgatcattttgtattctggagacaaaatttatgataactactatccggatctgaaaggacgggtacattttacgagtaacgatgtcaagtctggcgacgcatctataaatgtgaccaacctgcagctgtcggacattggcacttaccagtgcaaagtgaagaaagcccctggggttgcaaataagaaattcctgctgaccgttcttgttaagccttcaggtacaagatgcttcgtggatggatcggaagagattggaaatgacttcaagctaaaatgtgaacccaaggaaggctcccttccactacagtttgaatggcagaaactgtcggactcccagacaatgcctacgccatggctggcagaaatgacgtcaccagttatatctgtgaagaacgccagttctgagtattctgggacatacagctgcacggttcaaaacagagtgggctctgaccagtgtatgctgcgactagacgttgtcccaccctccaaccgagccggaacgatcgcgggcgccgtcatagggacgctgctggcccttgtgctcatcggggccatcctcttctgctgtcacaggaaacgcagagaagagaagtacgagaaggaagttcatcatgatatcagggaagatgtgcctcctccaaagagtcggacatccactgccaggagctatattggcagcaaccattcctccctgggatccatgtccccctctaacatggaggggtattccaagacgcagtataaccaagtccccagtgaagactttgaacgtgcgcctcagagcccgactctggcacccgctaaggtagctgcccctaatctcagtcgaatgggagcggttcctgtgatgattcctgcacagagcaaggacgggtctatagtatagaactccgcacctctctgttctgctgtccgtggctcgtttcttctcttgacatatcaacatttattctattctaaattttgttaacagtagcccatatatataatatatatgtgtgtgtatgtgtatgtatacacatgtgtacacatatacgtatgtgtgcacatgtgtatatatgcataatatatatgcatatatacgcacttatatatgcatatatatatatgaagaagtttataagaatcatactccataagatttttttggttattgtgaaacaataaaggcttaagagtaatagcattgaccatctggaaaatttggggtttcttaccaagttgattttaaggcccttatcttatatctgaagaaagatatagcactttgaatatgatgtcatgggtgaagaaatttgtgagtttacacacatcccaagttgattcttgaatcatctgaaaatgatacttcgtagtttctaccattattttcaggatatctgtctcatttattgatgaacatcagtatctctcaaattgaaaaacaaatccatggaaaaactgcttaatgtatgaatttgtttttatagtctgagaattctaagtgtatttggttacctgtaaaagtaggagacatgactgttttagaaatgactagttttctttctaagtcattcctaaacatctatgacacgatttctttcctgtctttttttcttttgttgctgtttggagatagggcctcagtgtgttcgttgcctaggctggcctcaaatcctgatccttctgctccctgaatgctgggctctcaaggctgtatggctgtagaacagtttcctaagcatttaaccggtacactacagaggtagcaggaagcaggaagctttagtgcactacaaaagaagcgtccgctacacagagctgaaacccttgatgctgcatgggtcggggtagggggaggatcgatgaggacagtgtctgtgcctcgctcggggcctgtggactgctgcaatcctgagcaggcagggtgagggtggcagatttatgggtctgtagctaaacactgcccttctactgtaagtgatggttttgcaattggaaaggaaggaacagagggagggaagggagagagggacagaaggaacgaaaggaaggaagaaaggaaagaaaactgttaattcacttatctggatgagaattctcaaattactgatttttaaatgtgtgtttttgttttgtggcagaccgtactgcacattttatgttgtaatctaggcttttgagttgtagtacggttcctggaggctatttttttcctctaagagtcagtgaacaaagagatttgaggcaagttaagtgtcttccctggtcctgaattccagacttgagcaatgtgcttgctggcccgtggccgcacctgcctctctctagctgtcagaaatcaagtctgagtcttagttttgtgaaagtgacttactcttaaaagaaattttaaaaggagtaaagggaatactcctacctgccaaatgtattaaatatagttttcgtagg

SEQ ID NO: 428 - DNA, 2187 bp, Mus musculus
cgatttctcggtactcttcagggatgagtcatgtggcagtggaaaatgcgctcgggctggaccagcagtttgctggcctagacctgaactcttcagataatcagagtggaggaagtacagcaagcaaagggcgttatatcccacctcatttaaggaacagagaagctactaaaggattctatgacaaagacagttcagggtggagttctagtaaagataaggatgcatacagcagttttggatcacggggtgattcaagagggaagtctagcttctttggagatcgtggaagtggatcaaggggaaggtttgatgatcgtggacggggagactatgatggcattggtggccgtggagatagaagtggctttggcaaatttgaaagaggtggaaatagtcgctggtgtgacaaatcagatgaagatgactggtcaaagccactcccaccaagtgaacgattggaacaggaactcttttctggaggcaatactgggattaactttgagaaatatgatgacattccagtcgaagcaacaggcaacaactgtcctccacacattgaaagtttcagtgatgtcgagatgggagaaattattatgggaaacattgagcttactcgttatactcgcccaactccagtgcagaagcatgctattcctattatcaaagagaaaagagacttgatggcttgtgctcaaacaggctctggaaaaactgcagcatttctcttgcccatcttgagtcagatctatgctgatggtccaggagaagctctgagggctatgaaggaaaatggaagatatggccgtcgtaaacagtatccaatctctttggtactggcaccaacgagagaattggcagtgcagatctatgaggaagccagaaaattctcataccgatctagagtccgtccttgcgtggtttatggtggtgctgaaattggccagcagattcgagacttagaacgtggatgccacttgttagtagccactccaggacgtctagtggatatgatggagagagggaagatcgggttagacttctgcaaatacctggtgttagatgaagctgaccggatgttagatatggggtttgaacctcagatacgaagaatagttgaacaagacactatgcctccaaaaggtgtccgccacactatgatgtttagtgctacttttcctaaggaaatacagatgctggcccgtgatttcttagatgagtacatatttctggctgtaggaagagttgggtctacttcagagaacatcacacaaaaagtggtttgggtggaggagatagacaaaaggtcatttctgcttgaccttctaaatgcaacaggcaaggattccctgactctagtgtttgtggagaccaaaaagggggcagattcgctggaggatttcttataccatgaaggatatgcttgtaccagtatccatggagaccgttctcagagagatagggaagaggcccttcaccagttccgctcaggaaaaagcccaattctagtggctacagcagtagcagcaagaggactggatatttcaaatgtgaagcatgttattaattttgacctgcctagtgatatcgaagaatatgtgcatcgcataggccgtacaggccgtgtgggaaaccttggtcttgccacctcattctttaatgaaaggaatataaatatcacaaaggatttactggatcttcttgttgaagcaaaacaagaagtgccttcttggttagagaacatggcttttgaacaccactacaagggtagcagtcgtggacgttctaagagcagtcgatttagtggagggtttggtgccagagactaccgacagagtagcggtgccagcagttccagcttcagcagcagccgtgcaagcagcagtcgaagtggtggaggtggccatggcggcagtcgaggatttggtggaggtggctacggaggcttttacaacagtgatggatatggagggaattataactcccagggggttgactggtggggtaactgagcctgctctgtagtaggtcaccctgccaaacaagctaatatggaaaccacatgtaacttagccagactataccttgtgtagcttcaagaactcgcagtacattaccagctgtgattctccactgaaatttttttttaagggagctcaaggtcacaagtaaagatgaaaggaacaa

SEQ ID NO: 429 - DNA, 316 bp, Mus musculus
catcctgaattacctcgcccagaaattcgaacttgctgcctgctgagtccagaagttgtccagggagtgagacggcagagtataagttttgattagtagttttttgtttttgtctttcccctctccagtgttggggattgaccccagggcaaagccattaagtgtgccactgacctgtgcctccaagtgatgttctgacagcctttctgaggcaatcaattgaattgaggttttgggagaagaaactgttgttcataggctatttctattttaaaagatgtgaagagaaaaaaaaaacaataaaattataaaagtg

SEQ ID NO: 430 - DNA, 752 bp, Mus musculus
agcttttggaaaagcacaggcagctgtcccgtgacatcaacaacctaaaaggaaaacatgaagctctcttggccaagtttcccaatcttcaatttgcatacaaggacccagagaagaactggaatcgaaattctgtgaaaggacttgtagcttctctgataaatgtgaaagataattctacagccacagctctggaagtggtggctggggaacgactctacaatgttgtagtagacacagaggtaactgctaagaagctactagaaaagggggagttgaagcgtcgatacacaataattcctctcaataagatttcagccagatgtattgctcctgaaactctgagggtcgctcagaatcttgttggtcctgacaatgttcatgtagctctttccttggttgactataaaccagaacttcagaaaggaatggaatttgtctttggaacaacatttgtttgtaacaatatggataatgccaaaaaagtggcctttgataaaaggataatgaccagaactgtaacccttgggggtgatgtatttgatcctcatggaacattgagtggaggtgctaggtcccaggcagcttcgattttaaccaagtttcaagaagtcaaagatgttcaagatgagctgaggaccaaggagaatgaactgcgcgctctagaagaggagttagcaggtcttaaaaatgttgctgaaaagtatcgccaactgaaacagcagtgggacgatgaagacagaggagggaga

SEQ ID NO: 431 - DNA, 752 bp, Mus musculus; identical to SEQ ID NO: 430

SEQ ID NO: 432 - DNA, 752 bp, Mus musculus; identical to SEQ ID NO: 430

SEQ ID NO: 433 - DNA, 325 bp, Mus musculus
ctgatttctcattccctcctacaaccattctgaacttcaactcacacattttccatcttttccatccaccagaagccctgacgcgtgttcagaacacaggcttattctttttctttttttctttttgtttttatcattatgtcatcagtaatcactgccaacgaaaaaaaacaaaggccaggtactacaccttcggggattataggtggactaaccacgtctctccctcctaaattcctgtatggacttgagatggcttcattgaaaaaccacacggcagatgaacaacctatgcccaaaacgtccaataaatgtctccaccccc

SEQ ID NO: 434 - DNA, 1656 bp, Mus musculus
cgagcgataaatacagggacgactcgcaccgccctcgcccgccgccgccgctcctgcagctgcagcggcgcccgcacaactttccgcccgcgcctccgcgagcgcgccgctaccactctggctgtctccactcccgcgtccttgccgccccctctccttctctgctgctaggtggccaagaaggaagacgcaattcagtcaggatggctaaaggtgaccccaagaaaccaaagggcaagatgtctgcttatgccttctttgtgcagacatgcagggaagaacataagaagaaaaacccagaggttcccgtcaattttgctgagttctccaagaagtgctcggagaggtggaagaccatgtctagcaaagagaaatcaaagtttgatgaaatggcaaaggcagataaagtccgatatgatcgggagatgaaagattatggaccagctaaaggaggcaagaagaagaaggacccaaatgcccccaaaagacctccgtctggatttttcttattctgctctgaattccgccccaagatcaaatccacaaaccctggcatctccattggagatgtggcaaaaaagctgggtgagatgtggaataacttaagtgacaatgaaaagcagccttatgtcaccaaggcagcaaagctgaaggagaagtatgagaaggatgttgctgactataagtctaaagggaagtttgatggtgccaagggtcctgctaaagttgcccggaaaaaggtggaagaagaggaagaggaggaggaagaggaagaagaggaggaggaagaggaggaagatgaataaaagctctgtctccttgtgaataccttagagtaggagagcgctgtgattgacacatctcttatttgagtcgtgtctattgcccttgttaggtttaattacaaaatttgatcacgatcatattgtagtttctcaaagtgtcagtggtttacatgaagtggccgtgggtgtccggagcgccctgaaactgtatcaaagttgtacatagctccaaacatttttaaaatgaaaaggcactctcgcgtcctcctcactcagtgcactttgctgttggtgtgacaaggcatttgaagatgtttctggcattttgttctcaactcgtaaggtagtgttaactatatggttattggctagcaatcctgagttgtcaactgtacatatctatagtttgtaaagagaatgaaacaacccagacagattcttgatgctccttgtttggcgtggaggctgtgaggggaagatgccttttggagggggccgtagctcagggcgtgcactgtgaggctggacctgttgatactgcggtgggcatccatttagcttcaggttgtcctgtgtttgtatatagtggcatagcattctgctgacattcttagttgtggaaaggggggaggggtcggccggcatgagaagtgtttggagttttttctttagttaagtgcagtaggtttgaaactttttaaagaaactgtaggactcatcattgtcagcaaagcaaagaactactgcatcaatggaagttcaagaaccctctggacctaaacgcaatttgcaacattctgttattttttgtatgtttagaatgctgaaatgtttttgaagttaaataaacagtattacatttttaaaaccg

SEQ ID NO: 435 - DNA, 714 bp, Mus musculus
ttaagccaagaaagggatacctaagaaaggattcttcgatacaacaatgcatgtactggtcagctttacattgtgtagttgagctgtattttgccaggccgccatagagaaaaatgccccaaaaaacttctggtggtggtgctgcagcttcttgatgcttccaaggactcgggttgattggcagagtgatgccagctgagacaggcgattgtgctgaggcaaggcatgtggaggacacgtgatctatggagggactaaatagaacttgacggacagtggcagaggctgagcttggcttgtttagagagctagctgtgcaacagtttgtcagtctcgcagcattgctgatcactgctgagaggagaggcacaaccaggaacttctcagggcattcctctgggtccttcctgctgactcaagctgaagctatggccaggttatctctgctaggtcatgtctccactgttgattcgtgtttgctatcccaactctactgaactgcactgctgtgtatctgtgaaaagtttgttgccgccatctgctaacctgtaaactgaactgcagatttccagacaacacagacaggagttgctccaaagaagttttctaaacaggtccacttcccccatatcctttctttcccaccttctgttgggtggtgggctaaaagagggttaactcatttaagaatttgaaaaattaaagttacaatta

SEQ ID NO: 436 - DNA, 1056 bp, Mus musculus
ggattgctgtctcatctggacccaggcgtcagaatgtcctttcctaaggcgcccctgaagagattcaatgacccttcgggttgtgctccatctccgggtgcttatgatgttaaaacttcagaagcaactaaaggaccagtgtcttttcagaaatcacaaagatttaaaaaccaaagagagcctcaacaaaatcttaacattgacaaagatacaaccttgcttgcttcggctaaaaaagcaaagaagtctgtgtcaaagaaggactctcagaagaatgataaagatgtgaagagattagaaaaagagattcgcgctcttttgcaagagcgagggactcaggacaaacggatccaggacatggaatctgaattggagaagacagaagcaaagctcaatgcagcagtcagagagaaaacatctctctctgcgagtaatgcttcactggaaaaacggcttactgaattaaccagagccaacgagctactaaaggctaaggtacttgagcttcgtgacagcgtcagaagtgaatggctgatacgcacgcaccttcacgttcaggttgtttggcagcttaagctgtgacgcttaccagtgcagctgaggctgttcattcacttacactgtaagtagaggagctcttgcttacactgtgcctgatcacacaaaccagagacacagttcgcaaggctgagtactggtctatttcaaggaagctgtaacggttctgaacagaatgcagtagataatggcaaaccattagtctggctgtgactgttaaattaactacttctgtaggcgagtcttacctttttaattaaaggggatttggcatgggttaaacaaaaggcagctatttgttcccatgcccgatattttttcacccctgccacaccccagtaaatatgaccatcaggctattacacaatttacattttgaagtctctttttaaaaaatcctcccctgaaaagacatagtgtcaaataggagtaatactgcactcgggagctgaggcaggagggttttaggccagcctacactacaagacaacatgtctc

SEQ ID NO: 437 - DNA, 484 bp, Mus musculus
tttttttttttttttttctctgtgtagtcttgactgtcctggaacttgttctgcctccagattgctgggaataaaagtgtgtgccaccactgccagctttcttaccaaatgctaaatggaactagcaaagtcaaacaaagtcccattaccttgcacccctccctcatttgaaggaatttatggagttctccttaaagaatgtctttatcaagcagatcctctccaatggctggtgttcagacactcagctcaacacttgaacactaaggggaaatgacttcagaagttagcaggtaagcatgccttcatgcatccctggtgtaaggcagtgcagtgacccacaccattacacatgatttacctgcgtgcctgctgcctcacttcagtgagactgaaagctgtacccagtacaagggcgagcaggagccgcaccgtggacaacatctacccttgggtcagtgctgacccagatcctcagaaccac

SEQ ID NO: 438 - DNA, 610 bp, Mus musculus
cattcaggtgtgcacatttcaagcggcgaacagacagcgatggagaacaaaggtccccgaaacaacgcctcaggacaagatggcgaccgcagcaagtcgcggcctccggggacaacgcccacgcgcctgccagtgagcgcgcgactcgcgcccgcggcactcgcccgcaaattcgcgtgcactggagcatccaataaacgctacagttaaagccgaacccgttttctccacgcccctcacacatgcgcttcacgacctctgtccggagcggagaacgcatgggtacaaacgccactccttctgcgcaactgacgcaaggagacttgagatccggttggaaatttatctcggtctgacccttggggctcttcccgttcttaaaggcccggggacctgtcccaacgcgaatgccgggcaaactcggccttgctgctgtgccgtgtcgccgaggtttcacaagcctggacaaccggtcgttgagcgaatcgggaaacttcagcagttatagtgcgagaggcttcacgccgccgtcgcgcatttccgggtgacgagggacccttcttccggggtgacgacaaggctcggcgccggtaagaaacggtgtcctttt

SEQ ID NO: 439 - DNA, 320 bp, Mus musculus
aagtatatatttaaaaaaaaaaataaggtttcccttgtgggcagacagcagctacacgcttttttcctgtgctactgtagcaaaccacagcatcgatgagaaggcatgcggactgtgcttcacttcacagtgtatacccgagcacttaataaaatgtaaggctggtatatatttgaagttgtacagtatgacttaattcaaatctgttggaatagaaaatatattctgttgagtgtttaagaggctgtacatgttttcttttgtgtttggattctttgtgctttttcatgttcggtacatcaataaacaaagttgaaggg

SEQ ID NO: 440 - DNA, 320 bp, Mus musculus; identical to SEQ ID NO: 439

SEQ ID NO: 441 - DNA, 286 bp, Mus musculus
gttcccagagctgcggaacgacatctccacacgaataaccaaagacaacccaaagtgccgcctggtgaaagaaacccgaatttctgaagtgcctccttgttgacaaccactgtacaacagcctaaaagtaagtttctttcagggcttgaccctgatgaccccacaggtgggtgggatatgagcctcttttctaaaaagaaaaaaagaaaagtccatgatatatctgaaaagaaattttctttatgaagcccaacactatgtacagtggttaaaagcatacctccaa

SEQ ID NO: 442 - DNA, 286 bp, Mus musculus; identical to SEQ ID NO: 441

SEQ ID NO: 443 - DNA, 950 bp, Mus musculus
tatcccgcagaaactctcggattcagtcaggtgggtacccggcacctccgcagcaagcccgttactattgttgaggagaatggcttccctgtgttgcagcggataacccgggccacagctgcagcagcggcagcagcagcggcagcgtctgtggcatcagcttcttcctcttccactgctgggtctcccacagtgctgaccaagaaagcagtggtggagataagcactagtgaacgactgagtgcagaactacaactcactaagctcaaaggtagccttcctccatctccagtttcccaaggcaccctgacatcagaggaggaactaacacccaagaaatcagaggctggaaagctggactctgtcacagtgaactccctcaaggctacccctcagagccccaagaaccgaggggttggggaaggacgttctgtttccaagctcaagattgctcgggcctcctgggggctgcaggactctcctggctctacagactcaccatggcaagagcgggtgctttctcctatcctgctgaataacatcttgcccacaacagccaagagccctcttgggaatattcggtcagtgcggcgaagcctgatttcccaggattcccaagtgccactagcctcgaagtataatttggtggccaaacaagaaaatggcagtcgcagatcaagcagaaggattgccaagaaggctggcaaagagccagaggcctctgctcgaatcatttgtcacagttacctggagaggctcctgaatgtttgaagtgcctcagaatgtttggcctggagcaaagagcctgtcgaggtgggcgaacctgaggaggccagaagaggaccaagaggtctccaagaacagtggggtgtcctccaaacccgaagtgccaccaagattgcgattaagtacgcccacctcgaaagctggcggccgcaagcttattccta

SEQ ID NO: 444 - DNA, 611 bp, Mus musculus
actaatttctttctcctgttcactggttgccttaaccctactaaagcatgatgcttttcaaggtcctggtgatcactgtcttctgtggtctgactgtggctttccccctgtcagaattagtttcaatcaataaagaactacagaattcaatcattgacctactaaactcagtctttgaccaactgggatcatacagagggacaaaagctcctctagaggattatacagatgatgatttaagcactgactctgagcagatcatggacttcacgccagccgcaaacaaacagaattctgagttctctactgatgttgagacagtctcctccggctttctggaagaattcactgagaacacagacatcacagtgaaaattccattagctgggaatccagtctcccctacttcctgagaagactccaactttgaaataaacctgcgactgccattcaggatattgtctttgtagaaaatgatataaatctaagatgctcccagcaaagaagaaagaacgaggaagtgatcctggatgagaaatgctgtgccaggcatctctaagctctacccttactctgtgtgggtttaagaaataaacgttcatttgaattgc

SEQ ID NO: 445 - DNA, 432 bp, Mus musculus
aattctaagctcaggagagctttgccaaaaacctcaacagtctgtttaataatatgaagaattgattaaggatggcagtgcgaaacaaaaggccatgctagacgttcataagacactgtttggtaacctgatgtcttctagtgtctctgcattagacaccattaccatgacagcacttgaatctctcgtgtctattccagaaaatgtgtccgctcgtgtttctcagatttctgatatgatattggaagagcaatcgttagcagcacaaagtaaaagtgttctgcaaggattgattgatgaacttgtgaccgaccttttcacttccctgaagaccatcgtagcccctagtgtgggtttccatcttgaacataaataggcagctacagcatattttcagggcttcatcgacagtggctgaaaaggtagaagatc

SEQ ID NO: 446 - DNA, 432 bp, Mus musculus; identical to SEQ ID NO: 445

SEQ ID NO: 447 - DNA, 597 bp, Mus musculus
  modified_base (478)..(478): a, c, g, t, unknown or other
tttttttggaattcttagctcaataacctcatcttctgttataataatatgtgtcccaggactccaagagtttctgtgtttaggattgctcttaaagggaaagcggggcttccggttctcaggagggatgaacctgtggggtacgttctgccgacgaagctgctttgttatctcttgctgttgcaggttcttaaaccgaatttgttcttgcctcatccaacgtagacgtccacgtctaaaagctggatccccgttcatcagctgggaaacgcgctcttctttgccaagttctccactctctcctttactgacaccattatcagagacgctggtagcaccagcaactaggggctcttttgtcttggggcttccttgactcttctgttcctgtgatcccatcaatggcaagactttctccattttgagcattgtatttctttagactgggatctcttcggctttcatattaatatggctnttgacttcttgcaaaatatcttccagcttgtcttgtgaaccttgagggcatgtacatctgttgcaccttatccagtgaccatcatatggttcattttgtcatgcgctacccgaacatgt

SEQ ID NO: 448 - DNA, 982 bp, Mus musculus
ggcggctcggaccgagcagggctttccttgccagtggattgtgtagagtatacagccagtctcttgtcttctgttcgacatggcatcttctgatattcaggtgaaagagctggagaagcgcgcttcaggccaggcttttgagctgattctcagccctcggtcaaaagaatctgtccccgatttccccctttcccccccaaagaagaaggacctttccctggaggaaatccagaagaaattagaagctgcagaagaaagacgcaagtctcatgaggcggaagtcttgaagcagctcgcggagaagcgggagcatgagaaggaggtgctccagaaagccatcgaggagaacaacaacttcagcaagatggcggaggagaagctgacccacaaaatggaggctaacaaagagaaccgggaggcgcagatggcggccaagctggagcgcttgcgagagaaggacaagcacgtggaagaggtgcggaagaacaaagaatccaaagaccccgcggatgagactgaggctgactaagttgtcccgagaactgactttctccccgaccccgtcctaaatatccaaagactgtactggccagtgtcctttactttccctcctgacagatagtctagaagccgatgtaggaccgtataggtagatccagaccgtgagatgttttaggggctcaaggggagaaactgaaagtgttttactcttttttaaagtgttggtctttctaatgtagctatttttctcgttgcatcttttccactcgggcacaatcggtgtgctgggttaatggctagtactgtattgactgtggaagacgtttgtgaagagtatgtagtggcttcttccaacccattagatgctgaatatctgtccactttgcgatcccaattctgtcccaatctcaccagatgttactgtacttggatggctaataaactgcacagtgtgttggtggcaaaaaaaaaaaaaaaaaaa

SEQ ID NO: 449 - DNA, 320 bp, Mus musculus
ttttaaatagaaaagagaagaaaaacgttgtaagaaggcaatattaatctagtcaccatgtacgcactctggatggaggttctacagagctgttgattggtcaactacttctcttacattgttgactcatgaggggagcgggcaggcggggtgagggtgggggaaggctttctcttcaaattcgctagttgagtttttaagatagtgtaacatgcttacatttcttatccgacattaacaaataaaacgctgttttcctattaaaaaaaaaaaaaaaaaaaaaaaaaaaaaaaaaaaaaaaaaaaaaaaaaaaaaaaaag

SEQ ID NO: 450 - DNA, 568 bp, Mus musculus
tcaggatagttgtagctgagctatacacaggcttccttaaccagttccagaagtctcttacctgaccccctgaatgtttttgggggtgaaagcgcttgccaggcccaccaagcaccctaggttgagcatctgctgacattcccatcagtagcctctacattgctcaccttagcttcatcattgccctcccatgtacatcaatatcccttttgctcctcagtgtagtacctaacgcccccaccccctaaccagtcaagttcttacaggaaagttactatcccatattacccactcctagttctaccactctatctacctgctctttgattgaggcccataattactttactactgttccttaatggcaccagcttagccctaaaaataccctccaataggtcactgagcctgccatacctttgcgcatccttctgatgcactagtgttaacataactttccaggttaacataactcttgccttcctgtccatcaaattcttttaaaaaaaaatttcagccagggcgatacagagaaaccctgtctcaaaaagccaaaaaaaaaaaaaag

SEQ ID NO: 451 - DNA, 666 bp, Mus musculus
catgtggtgctgggattgaacttcggacctcggaagagcagtcgggtgctcttacccactgagccatctcaccagccccctgagtttattctataatccctttttattcaatgctggaagtttgagttttcatagtgttcctgttgacatttgtgttacttgtgtatcccagaagtgaattttgtgcagtagatcagcccactctggtactcaagagagtacaaagttaagcttcagtctgaccccacccagcctgagcagtgtagatggtctggggggtaagaggaatttctagatatagcatatgccactgacacttttgtatcttatgtgagaatatggacacatgcacctttgtggagatcagaggaaaactttctgggattatttttctcctgttcattccccagatcaaactcaagttgtcaaacttatgtggcaaatgtatttaagtgagtagtaacggccctcttaagatttatttattttgcttttttcaggcaagttctcactaagtagctgaaacttactgtgtagactgtgctgacttccaaagcagaagcctgtgtctgcctcccgagtactgaattaaaggcttgcatgagtataccagccttcttttaagattagggggaggggggattttcggaggggaaattaggaaag

SEQ ID NO: 452 - DNA, 665 bp, Mus musculus
cctcattggaccatgtctggctgaagtgagttagccacctacaggctttcaaagcagaacttcccgattcatcctgccaaaaggatatactcattcgagagatggcttcctgttggtacacagaaggaacactgaagtaagcctgggacaggataaagccaatgtgtcagagacaggaaatcttacttctgagtattcagggagaaaggagcattgctcaatgcactaggaattctacaaaaatggttaccccccccctgagattacacagcctaggaaccatgctggccctcaatcagtgcaattttgaaactgcaccgctgcaccactaaacaattacactttccttttaaggctgttaacctttctgtctggtagttttaaacacagttatctacactgtatatttgcctaagagcagtctttatggcaaaatcaaaagctgggtcattccatactcatttaaattaagggaacccagagaaaggaggcgacattcacatatgatgtcctgtaagtgtggttatttggactccagagcacttgtctctgtatatctgtaactttgattctgcatctgattataaagtggatagttttatttaaaaagcatggtccggctctcccatttaactcgaaaaagagacacactaaaggagttaatt

SEQ ID NO: 453 - DNA, 6683 bp, Mus musculus
ccggagcaagcgcgctgggctcccgtgccgcccggccaagcccgagagtcccgcggtcatggtctgtgcggtggcgcggggcgtgagcccgggactcgagctccggaggcggccggcgtgggcgctccccagaggccgacggaaggtgagcgctgtgggctatgggatggatgaggtggaggaggaccagcatgaagcccgactcaaggagctgtttgacagttttgacaccctgggaactgggtctctgggtcaagaggagctcactgacctctgccacgtgctgtgcttggaggatgtgggcccggtgctgcaacagacgctactccaggacaacctcttgggcagggtacattttgaccaatttaaagaagcattaatacttatcttgtctagaactctatccagtgaggagcactttgaggagtcagactgttccccagaagctcagcccaaatatgttagaggtgggaagcgttatggacgaagatcactgcccgagtttcaagagtctggggaagagatcgaggaggtgacagtgcttgagccactagaggaagaagcgaggtcatcacccatcccagctggggactgcggcgacgactggaagacacaacgcagtgaggagtatgaagcagaaggccagctgaggttttggaacccagatgacctgaatgcttcacatggtgggtcttgccctcctccagactggatagaagagaaactgcaagaggtttgtgaagatctggggatcactcgagatggtcacctgaaccggaagaagctggtttccatctgcgaacagtatggattacagaatgtggatggagcgatgctggaagaggtgtttctcagccttgatcccgatggaacaatgagtgtggaagactttttctatggtctgtttaagactggaaaatctctcacaccatcagcatctactccctatagacaactgaaacggcatctctctatgcagtctttcgatgagagtggacggcggaccgcaacctcgtcagcaatgacgagtaccattggcttccgggtcttctcctgcttggatgacgggatgggccaggcgtctgtggagaggatactggacacctggcaggaagaaggcattgagaacagtcaggagattctgaaggccctggatttcagcctggatggaaacatcaacctgacagacgtgacgctggctctggagaatgaacttttggttaccaagaatggcattcaccaggcagcactagctagcttcaaggccgagatccggcacttgttagaacgagttgaccaagtagtcagagaaaggagagcctacggtcggacctggacaagcagaaagctgaagtctctcatggcttccgaggtggacgatcaccacgcagccattgagcggaggaatgaatacaacctcaggaaactggatgaagaatacaaggagcgcatagcagccttaaagaacgaactccgccaggagagggaacagatgttgcagcaagtgggcaagcagcgggtggagctggaacaggaaattcaaaaggccaagacggaagagaattacatccgggaccgccttgccctctccctgaaggaaaacaatcgcctggagactgagcttctggaaaatgcagagaagttggcagagtacgagagcctgacgcagaagctccaggccagtttggaaaatgtgttagcagaaaagtttggtgacctcgatcccagcagtgctgagttctttcttcaagaggagaggctggcgcagatgagaaatgaatatgagcaacagtgcaggctattacaagaccaagtggatgagcttcagtctgaactagaagaataccaggctcaaggcagggtgctcagactccccttgaagaactcgctgtcagaagaactcgacggtcacagtggtggtattgagcccgaccaagggcctggatctgaagagtgcaaccccctgaatatgagcattgaggcagagctggtcatcgagcagatgaaggagcagcaccaccgggacctgtgtcacctgagactggagctggaagacaaagtgcgccactatgaaaagcagctggatgataccagggtcgcctctgaacaggagcaggcggccatgaagcagaagtatgagcagggagtgcacaccttggagaagcgagtcagcgagcttcggagtgagattgcagacctggaagggcaggcagccgtgctgagggaggcccaccacaaggccagctgcaggcacgaggaggaaaagagacaactgcaaatggcgttcgatgaggaaaaggctcagctccaggaggagctgcggcaggagcatgagagggagctccaggccaggctgcagcaggcagcggagacgtttcgccaggagagagagggactcgcccaggctgcctggactgaggagaaggtgagaggcttggagcaatcttaccaggagcagctgctgagcctggaggagaagcatgctctagagaaagaagagctgagggaagagctctcggaacatcaccgaagggaactccaggagggaagggaagaaatggaaacagagtgtaatagaagagtctctcagatagaagcccagtgccaggctgactgtgagaaagtcactgagcactgtgaacaaactctgcaaagcctcgaggttcgccaccgccaggagctgagggacctcttggaccagcacctggaggaaaggtctcagtgggagtttgagaaggatgagcttgcgcaagagtgcacagatgcccaggagcagctgaaggaggcgctccagagggagagggcgaccgctgcggccatgaagcaggaacaggagatactggagaggacatacaaggaccgtttgaatatcctgagcacggaaagagagcagctgctgcaagacctgaaagacctacagaacgcatctgagagccagcatggcctcctgtctggccagatacttgagctgaagagaagtcaggagagagaactgagggaccaagggcaggcgctatgccagacgggggtctctgagcagctggccagcccagagctcgaaaggctccgggttgagcatgagcaagagaggcgagaaatgacgggcaagcttgccgccctggagagcgcccacagagcaagccttgagagagcagatcaagagaaggcggagatgagcacagaaatctgcaggcttcagaatacagtcaaggacatgcagcaggcagcatctctcttgatgcttcagggtggctgccaggcaacggcaggggaggaggcagaaggagatggagccatgtccctgcttcagcaaggcgagcagctattggaagaaaacggagatgtcctcatcagcctgcagagagctcacgagcatgcagtgaaggaaaatgcaaagatggctactgaaatttaccaattgcagcagaggctgaagaagttagagccggggtcggtgatctcgtcttgtttggaggaggggacgtctgagatttctggaagttccagggaacaagtagaacccataatgaaacaaggtccagccaccaagcacttcctgagcgatctaggagaccacgaggcccgggacctggcaagtaccgggacaagctctgttcagaggcagaagtgcaaaaccgaggcgtcggaagcttccctggactgcttttctgagcttgaaaacagtgaagacaccaggaccgagtctgacctcaagagtcagatcagccagcttcgggagcaactgacggtcttgcgagcagactgcgatcgggcttccgagaggaaacaggacctgcttttcgatatctctgtgctgaaaaagaaactgaagatgctggagagactcccggaggcatcttccaggtataaggtattatacgaggatgccgcccgagaaaactcctgccttcaggaggagctgagacttgtagagacgcgctacgaggagtcgctggacagcaacaaagagctcacggcggaggtctacaggttgcaggatgagatgaagaaaatggaggaggtgatggagacgttcctcagcctggagaagagttacgatgaggtcaaagtggaaaatgaggaactccgtgctctggtgttgagacttcaagggaagatggagaaggtgctgggaagggccgccctgcagggtgacagctacgcctctgggaagcccccttcagaaaacctggaggtcgcctcggatgaaaagatgcttgaactccgtcagactccgaaagagtgtacgcccaaggtcgtgagcatgcaccacatcatagaagagtgtacacaagaaacccagtgctgtgagcagggaagcacgaagctcctagctagaataaaagcacacgaaatcgcctggttccacagagcaattaagacacatccggaaaagcctagcgcgcagaaccgagtcatcccggagggaagtgctgctctcctaggcctacaagacaagcatcttcagcaggaggccaccatcgcagagttagaactagagaagcaaaagctacaggagctgactagaaatctgagggagcgagtcactgcactagttaggcaaaaagacgccccttctcaagggcagaaggaggaggagctgaaggcaatgatgcagcctgcagtcacgtgcggggagatgcagaggaaggttgaactcctgagatatgaatctgaaaagcttcaagaggaaaattctattttgagaaatgaaattactactttaaatgaagaagatagcatctctaacctgaaattggaggaattaaatggctctcaggaagaattgtggcagaaaatagaaaccatagagcaggaaaaagcttcaattcagacaatggttgaaaaattaaagaaacaggtttcagatttaaaaatcaaaaaccaacagttggattcagaaaatatagaactcagccaaaagaactcccaaaacaaggaagaactgaaaacccttaatcaacgtctggcagaaatgctgtgccagagggaggagccaggagcttgcacctctgagaaatgggaacaagaaaatgcaagcctcaaagaagaactggatcactacaaagtgcagacttccactttggtgtcttctctggaggcagaactttccaggattaaactgcagactcacgtcatggagcaggaaaacctccttctcaaagatgaactggagagactgaagcaactgcacagatgtcctgacctctctgacttgcagcaaaagatgtctagcgttctaagctacaatgaaaaactgctgaaggaaaaggaagttctgagtgaagagttaaagagctgtgcagataagctggcagagtcaagcctcttagagcacagaattgctacaatgaagcaggagcagaccgcctgggaagagcagagtgagagcctgaagtcacagctggcagtgtcgcaggcaaaggttcaggacttagaagatgtcctgcagaatgtcaaccttcagatggctgagattgaatcagatctccaagtgactcgacaggaaaaggaggccgtaaagcaggaagtgatgtcattacacagacagcttcagaatgccattgataaggactgggtctcggaaacagctccccatctctcagggctccggggccagcagagaaggctgtcctgggacaaactggaccatctgatgaatgaggaaccacagctgctttgtcaagaaagcaagagactccagactgtggtacagaatacccaagcagatctcacccactcccgggagaaggtccgtcaactggaatccaacctccttcccaccaaacaccaaaaacaactcaaccaaccatgtactgtgaagtccacagaacaagaaaaactgaccttaaagagagagtgtgaacagtctcagaaagaacaatctcctaccagcaggaaggtgggtcagatgggttcccttgagcgaggattagaaacaatccatttggaaaacgaaggtctgaagaagaaacagatgcagcccctgaggtccactgtgacgcgtagcccatcctctcactgggatctgcagttgctccagcagcaagcctgtccgatggtgcccagggagcagtttctgcagcttcaacagcagctgctgcaggcagaaaagagaagccagcacctgcaggaggagctcgaaaacagaacctccgaaaccaacacaccacaggctttgctactggagcagcgagctgtgcatgcagattctgcagaaggattgggcacctctgaaaactgggctgctgttgatggcatttgttaccacgacagagtcttaaatgacacactgcacacacgtacatgcacaccgcacacagacatgatctgggacatgttggaatcaagtgctcttttaaaatatttgactgttaccatcactgttaaagccttcacagtattgtctcttacttatgtagacatgaaagactttgtgattcagtcacaaacttctgcttgctacaaatcagcttatttatatggtttaaagagtggatttaagagtcttgaaaggatatattctatatattttctaattccatatgttgttaattatttttaaaagaaggtactacttttatatatggaatttgaagaaaatcagggttatttatactgttttgtataagatgtatcatacttttgacagaaaaaagggaaattttgatgcaacaataaaa

SEQ ID NO: 454 - DNA, 717 bp, Mus musculus
ctttcagataaggtctcactgtgtatctttggctttcctgaactcatgtagcccaggctagccaagaactcaacagacaaacacatgtgctgggtttaagtgcagaaagcaccacagtccccccaaccacttttctgtaaatgaaatttctagctcctagagcacagtaatcagcagccagctcattatcaattggccacacctcctaagcacccctggtcctgctgactttgcttgagcttggggttttttttaatgagtcacatctccctacaaaactgaaaactggtcactagcagaaccctagtccattactgcaatcggtaaggaaatactgtaaaaaggaaaaagctggtttaaaaaaaattggtaagatggaacattgaacatacagccacaaaataaatggaagaaagaagaggcaagattctgagcagttggaatattggtccactgacacaaatgtataaagttaactataaccatggcaatttgaggttcggcttttcaaatcccaggacctttaaaacctgggcatgtctggatttaaaaaagaaaagaaaaccactaagtttcaagtctttcaagttttgttttcatagaagttctggttactctatcccaagctaccttcctgtaccttacattctgtcacctgccagagttgaaagctgtaatgaagtgacactaaaagtgccccttagagagcaaggggca

SEQ ID NO: 455 - DNA, 679 bp, Mus musculus
gcttgctgctgcttttgtttcttgggttttattgatttagttggaagattgaggtaaataggaaaacttacagagatgcctgatcaacctttttggtatttaaaaaacaaaaacaaaaaacacgtgcatgatacctaaggcaggctgcacggactgaattatagttgattgatgggtatttaagtcagaaattactttgggatttttgaaaagtagatgaacttgagtgttttgcttttgagtgtggggaagtgtttattttgatactttatgcttttaaaatataaacgctaaggtaaaaaataaaatgccaacaaaatattcaggttacagcttgcgctcagcctcatgcagaccctgttgagagccacggcaacaaactttacagatgtgccttccagctgtatcgtcagtctgggaccatagctgctttaaatacagaatttgggtcatttacaatcaaatttccttttaaagaactgtcacttgtccttttacatgttagcgataggctgcattttgcctgtgtctacgtgggctggaaaatgggtttcttgggactgaagaataggagaaaaaagtcaaacatgttgattttctgaaggaggaaaaaagatctgcaatatttaataaatacttaaaatttttctttttaaaaaatgtttacacttctctgtcc

SEQ ID NO: 456 - DNA, 656 bp, Mus musculus
  modified_base (593)..(593): a, c, g, t, unknown or other
attcagaggaagagctaaggaagaaaatgatagaagaagaacagaaaaaccatttatctggtgaaatatgtgaaatgcagacagaagaattagctggaaattctcagatactgaaagaacctggtaaaagttaccaattttaattttatattgaaaaatcatgatcttaccagtttagtttttgaaaatatactattacttcttagaaaatctaagcctactattgaaaaaggagatgttctgtcaatgaattcaggtcctttattcttttcaaattatgtaagattatgttttttattattaaaatttttagtttaataaagtattagatgcaatgctaacactaatgctttatgacttttttaatgcttaaaattcatgtaatatcttttatccccttgtgaagagtacgggttgagatccattttccctcctgtcatcgctcatattatttgtgaggttttgtctgtattgttttaaatatccttaaaccttcttcgatgtagaaagtaaaaacccctatttttacatcatgaatttttatttagataaacacattattataattgtagtaattataccttgtttcccanatacacacacacacacacacacacacacacgagttttcctcgtatcaaaatcaaaggactttt

SEQ ID NO: 457 - DNA, 2072 bp, Mus musculus
cggacgcgtggggaggaactgtatgaaatgctgagcgaccactccatccgctcctttgatgatcttcagcgcctgctgcacagagactccgtagatgaagatggggctgagctggacttgaacatgacccgagcacactccggagtcgagttggaaagctcatctcgagggaggaggagcctagggtccctggcagcagcagagcctgctgtaatcgccgagtgcaagacgcgcacagaggtgttccagatctcgcggaacctcatcgatcgcaccaacgccaacttcctggtgtggccgccctgtgtggaggtgcagcgctgctccggctgctgcaataaccgcaatgtgcaatgccgggcctcgcaggtgcagatgcggccggtccaggtgagaaagattgagattgtgcgaaagaagcccatcttcaagaaggccacagtgaccttggaggaccacctcgcctgcaagtgtgagacaatagtgacccctcggcctgtgactagaagtcctgggacatccagggagcagcgagccaagacgcctcaagctcgggtgaccattcggacggtgagaatccgccggccccccaaaggcaagcaccgaaagtttaagcacacccatgacaaggcggccctgaaggagaccctcggagcctaggggcgtcggcaagagtgtgggcagggttatttaatatggtatttgctgtattgcccccatggggtccttggagtgataatgttgttcccctcgtccgtctgtctcgatgcctgattcggacggccaatggtgcttccctcaccccgtgtgcccggccacctccaccagcagcgatccctcagcccgccctgcagctccacatgcaaaggactccactccaggctgcaggcttctcttgactccaagaacctggaacaagtgtgcaggagccttgccgggggactgtggactggccccagagcctggcacttagcctgaggacctctgcatgtcctgcctggttcctggaccactggccagccagcagggaacatgttcaggcaggctagggtcccttgcagtcctgtggcagggagcacagactggaggaactctgatggcacccagatctgccacgcactcatctcttcctgtcccctcagcccacagtggcttttcattttataagacatgaactcctctgggcaggtggccacaagccttctctgatggattagaggtgcagtgtgcgtgtgacctgggccatgtccctgcctctttccacttcccctacgttcacttccggttcatttctctacctccactctgtgtcttcttcctcatgtgcccttcagtctgctcctccacggggtgttcggatcccgattgaggccctgaatgcccgtcattcctccctagggcaggagacctgtctcttatattccactccagccaagcagggtgagcaaggttgtaatgggatgtatattgcacatgatgcactgcgtgtggagactgctgttcacaccctaaatatggccaacttgcctattatgacgttctggccaatgtaggtcaaacctctgaggaaagggaaccttgtttaattcataccgaggccctctgtggagtggctgtgtgtgccctggcccagcctgaagctcagaatgagcccatggtactggggaagcaaccctgttgtctgtccattgcctccacttcctgggtctcagctgtccccttccggacaggtgaggggcactaggagacctccaagggaggaacagccctcgctgcacaggtgtccctctgatcttttgcggttctacccgatggctccttccaggaagctagccagtagattggaagtgggggagagagggagagccctagagcccttgggaggacggattgacctggcccgcctcccttcccacactttcccgtccccgttccttctgcttccttcagtttgtaaagttggtgattatattttttgggggctttctttttattttttaaatgtaaagtttatttatattccgtatttaaagttgtaaaaaaaaaagccacaaaacaaaaaaaaaaaaaaa

SEQ ID NO: 458 - DNA, 581 bp, Mus musculus
tcctttgttaagcatctggagacaacgggttgagttggcagatactgtttatggaccctgaggtggttttaccgattcagtctcagttttattgaattcttgataacagggataggatttgcagggagagcagggatatcagaaaggtctgtactggatgttttctgagaggccaacagagaagccgatgccggaacagtttctgattgaaccgcacttgtctccagatcaacttgttcctttgtctctgttttatcatgtccactcaaagcaagacagttagcatcttcacttgtttcatcctcttctgttttggttttcttaggactttcttctttattgggtgaggacgttctcttgactcctactataggattagggacttttgttgctgtgtttcctgaaggtctaggcgatgggtttaccagtcgtgttgaggagacaactctggagactgtaggctttggtggtggagaaatggctggctgtgtggcagtttgaggaatgctttcgctcgatggaccccctgggctttcactggaatttgcttgcggtacagaaacctcagaagcctggatgct

SEQ ID NO: 459 - DNA, 1043 bp, Mus musculus
  modified_base (52)..(52): a, c, g, t, unknown or other
  modified_base (82)..(82): a, c, g, t, unknown or other
  modified_base (330)..(330): a, c, g, t, unknown or other
aatgcgtatggaattctcggttgttgcctgtccgtgcgcagagatgtctagntgatcaaagatacctctgaaaagagaatcnaccgaaatatagctagtcgaaaaatacttgtggagaatctgctgagtagttacccagccatcctgtacttctggcaatgtttgtaagagtgatctatcaaattatgtgaggttgccaaaataggtaaaatatgtgattataaaaataagatgtacatctagtgtcatctctattacttaccctaatactgttctgtcagaatccgtatatttacataggtatatctataaatgttccttatgttcttnttcatacattgctgtggtagaaataaatatgcatctttcattatttttgggatgtccttgttgacacttgtataataaatatctttatatcattttcagtttttgtcacaagatactgaacatgattaggatgtttttgaaggtttcatcactttgatttgcctgaaaacagttgccaggtttttacagctttgacagggaatagttcttttaaaacatttatttcctatcttacagtttttaatctaagcatttttctgtttctcattaaaaccattcagttggtagataacttcaaccgtacgatttggttgtcatttcacgattatagaacaacattctcttgtcctctcagctccttgtgtgataacaacttagagtgtaatctgttatagttatcacctcccgggtggtgggggtcgggtaaaaatctcttctaaacttggtttttgaatctgtggtcttgtcttttctgttggctataactgaaacatgccaatctgtgttttcaagaatttttgtttaaggaagtattgtatggaagtttacacaatgaaggaagttcatctagacttgaatatgtaaacaagataacacacaagtgtaccaagtgattattaactttgttgtttataaatttgtatggacctggagtatctgttgcccattactatatatgtgcaaataaatgtgacttagacttgtgactgttt

SEQ ID NO: 460 - DNA, 2410 bp, Mus musculus
ccacgcgtccggtttggcgggtttttcctgtgctgtgctcctcacggagaagctaaggtgtagtcctcggaagcaagttttctctctggatcgagacctctcgagggcttttgaagtatttctctgtgacctggtggctggggtcgtttgagggcttaggccaggtggtctcgtgacacgtccctgtcaccttccggtaaagcgaaaggataagcgtctgcagggtagagctgaggtcggggcccggcggcaggcgcccggccactcccgggtcaccatggccgtgtccacccagcagctggcggaggaactacagatcttcggcctggactacgaggactccctgttggagaaactggcagagctgtgtgttctataccgacagactgaggacgggatggtcagtgagctcatcgccttctgcaccagtgcggggaagacatgccttactgtagacatcctgaactcttttgaatacgaggttctgaacaaaaaactctccaaagcctggcacagtgcctccaaagacagtgggcatgcaggaaccagagacattgtttctatacaagagctaattgaagcagaggaggaagaggagaccctcctaagctcttataccacaccctctaagggtcctctcaagcgagttagcagcaccccagaaacccccctaaccaaaaggagcgtcgctgctcgcagcccacgtcagcttctctcaccgtcaagtttctccccgagtgctaccccctcccagaaatacacctccagaaccaaccggggagaagtggtgaccacctttggctccgcacagggcttgtcttggtccgggagaggaggctctggaagcgtcagtctaaaggtcgtgggggacccagagccactcactggcagctacaaagcgatgtttcagcagctcatgggtgttcgagaagttctgaccagtaagatcgaagagctcggcagcgagctgaaggagcatcacaagatcgaggcctttacccctctcctggtcccagcgcaagagcctgttattctcctgggtcagattggctgcgacagcaacgggaagctgaacagcaagtccgtgattctcgagggggaccaggagcactcctatggcgcgcagatcccagtggacctatcggaactcaaagagtattccctcttccctggacaggttgtaattatggaaggattcaacaccactggtaggagacttactgccaccaaactctatgagggcgtgccacttccgttctatcagcctactgaagaggagggagcttctgagcagactatggtggtagttgcctgcgggccttataccacctccgacagcatcacctatgaccccctgcttgatctgatcgccatcatcaaccgtgaccagccagatgtctgcatcctgttcggacctttcctggatgctaaacatgaacaggtggagaactgtaagttgacaagcccattcgaagacgttttcaagcaatgcctgagaacagttatcgaaggaacgagaagctccggctcccaccttgtctttgtcccgtctctgagggatgtccatcatgagccagtatacccacagccgcctttcaccttctccgagctgtctcgagaggacaaaaagcgagtgcagtttgtgtcagagccctgcagcctctccataaatggagtgatgtttggtttgacatccacggacctgctgttccacatcggggctgaggagatctttagctcttccgggacgtcagacagattcagccgagtccttaagcatatcctgacgcagagaagttactacccactttatccaccccacgaggacatggccatagactacgagaacttctatacctatgcccagctgccggtcacccccgatgtcttcatagtgccgtccgagctgagatactttgtgaaggacatctttggctgtgtctgtgtgaatcctgggcggctcacgaaaggacaagtgggcggcacctttggccgcctctacctcaggaggcagcccaaggccatggacggtgggggcaggcagggcctgagcgtggcagcgcaggtggtcagaatctgagtcctcagcctggttgcctggcctcacaaacaccaagagcccaggtatggctctctggtggccaaactgttggagtacctgacaaggatctggccacagagacaggactgtagggctgggccgtccagtcacggcttcccactgtccctcacccccatgcagcgtggctctgatctgaattacgccctgcttctctcctgcttcatgaggtagatgtacagaagtgagccatctatggacacaaaggcaggaaaactgacttttttttgtatgaatcaaatacagcgtgtggagaaataaaaatttttttagtataaaaaaaaaaaaaaa

SEQ ID NO: 461 - DNA, 430 bp, Mus musculus
ttttttttttttttacaactgatagagatccattgacttttattacaaatgtacttgatcacttggcttcaaaaatttttaaatcaatataccctaatatctgtatgccagtacaaagcaaactgttttacaaattaaatacctaaaaacttgacaaaaatattaaaatttgatgaaaagcaattataaaaattcttaatctctctcttcaaaaaaggaggcagtcttcccagacctatcatacaatgttaatagtattcagcattttagaacaggtagctaaattatattttttatgtcagcactaaaaaaaacctcttaaactaatagattttatttgtatatgctccagttaagtttgtgaatgccatctgattgcaatataatcaactctctttaattcaattctaatttatacctatttaataat

SEQ ID NO: 462 - DNA, 3416 bp, Mus musculus
gaggagtcttgctgcgcgggtgggtagaagctgggatcagagaagcggcgaggcagacagtcttcggacatagactgactctgcttgtcatgtctcaccggatcctttctccgccagcgggcttactctctgatgaggatgttgtagactctcccatattagaatccacagctgcagatctgagatctgttgtccgaaaggacctgttgtcagactgctctgtcatctctgcctctctggaggacaagcaggctctactggaggacacctcagagaaggtgaaagtttaccttcgaattcgaccattcttgacttcagagttggaccgacaggaagatcagggctgcgtctgcattgagaatacagaaacccttgtgctgcaggcacccaaagactcctttgccttgaagagtaatgagaggggagttggtcaggccactcacaaatttaccttttcccagatatttgggccagaagtgggacaggtggccttcttcaatctgaccatgaaggagatggtgaaggatgtgctcaaagggcagaactggctcatctacacctatggagtcaccaactcggggaaaacgtacaccattcaaggtactagtaaggatgcggggatcctgccccagtccctggctctcatctttaatagtctccagggccagcttcatccgacacctgacctgaagcccttattgtccaatgaagtaatctggctagacagcaagcagattcgacaggaggaaatgaagaagctgtccttgctaattggaggcctccaagaggaggagctgtccacctccgtgaagaaacgtgtccacactgaaagtcggataggtgccagcaacagctttgacagtggcgttgctgggctgtcttccaccagtcagttcaccagcagcagccagctagatgaaacaagtcaattatgggcacaaccagacactgtcccagtaagtgttccagcagacattcgcttctctgtctggatctccttctttgagatctacaatgaattgctttatgacctgttagaaccacctagccatcagcataagagacagacacttcggctgtgtgaggatcagaacggcaatccttacgtgaaagatctcaattggattcatgttcgtgatgttgaggaagcctggaaactattgaaagtgggtcgcaagaaccagagctttgccagcacccacatgaaccagcaatccagccgcagtcacagcatcttctcaatcagaatcttgcaccttcagggagaaggggatatagtgcccaagatcagtgaactgtcactctgtgacctggctggctctgagcgctgcaaacatcaaaaaagtggtgagcggctaaaggaggcagggaacattaacacttctctgcacaccctgggccgctgtattgctgccctgcgacagaatcagcagaaccggtcaaagcagaacctgattcctttccgtgacagcaagttgactcgtgtgttccaaggcttcttcacaggtcgaggtcgttcctgtatgattgtcaatgtgaatccctgtgcatctacatatgacgagactcttcatgcagccaaattctcagccctagccagccagcttgtgcacgccccacctgtgcatctgggaatcccatccctgcattcattcatcaagaagcacagtcctcaggttggccctggcttagagaaagaggacaaggccgactcagaccttgaggacagtcctgaagacgaagctgacgtctccgtgtatggcaaggaggaactactccaggtggtggaagccatgaaagcgctacttttaaaagaacgacaagaaaagctgcagttggagatacagctccgagaggaaatttgcaacgaaatggtggaacagatgcaacagcgggagcagtggtgcagtgagcgtttggacaaccaaaaggaactgatggaggaactgtacgaggagaaactgaagatcctgaaggaatcactgacaactttctaccaagagcagatccaggagcgggatgaaaaaattgaagagctagaaactctgttgcaggaagccaaacagcagccagcggcacaacagtcaggggggctgtccctcctccggcggtcacagaggctggcagcgtctgcctccactcagcagttccaggaagttaaagctgaactagagcaatgcaaaacagagttaagctctaccactgcagagctgcacaagtatcagcaagtgttaaaaccgccacccccagccaagcctttcaccattgatgtggataagaagttagaggagggccagaagaatataagactgctacggacagagctccagaaactaggacagtctctgcagtcagcagaaagagcctgttgccacagcaccggagcaggaaaacttcgtcaagcattaaccaactgtgatgacatcttaatcaagcagaaccagaccctggctgagctgcagaataacatggtgctagtgaaactggaccttcagaaaaaggcagcctgcattgctgagcagtatcacactgtgctaaagctccaaggccaagcctctgccaaaaagcggctgggagcaaaccaggaaaaccagcaaccaaatcatcaacccccaggaaagaaaccattcctgcgaaacttacttccccgaacacctacctgccaaagctcaacagacagcagcccttatgcgcggatcttgcgctcacggcactctcctttactcaaatctccctttggcaaaaaatactaaagttgtggggatgaagatgcatggttgttgccctgaggttggtcagctgcttagctgataagtctcttttaagcttcagcatacacccagaactgtattcagaattattgtattataatcacctatgtaatcttgtttttttttttcatgcacaaatattatatggaataaagacattgtttatgcttttatttggattccaaatttagaaaaatataaaaagggggacagaaaattgatataaataccatctggcctgttagacccttggacaggaacagcagtgggaaccagcctaatgcacactaggaaatgagtacaattttaaatgatacccaagaggcttgggtagctttgtctggccaggaagttgctatgtcaaaacacccacctgcctgtctccaaatgggattaaagacatgcaccaccacatggcacccagttagtgttccttccattaaatggggagtaaaatgttctgagtacaagagaaggaaggctagctcctaaccacagaatgatctatagcacctactgcacaagctcattgtagcagacatcaagtggctctgaaacctagaaaaacacagtgaattcttcaaccttgtagataaggttgaaaaccaaattggagactttaaaatccgaagtaaaaaagcttcc

SEQ ID NO: 463 - DNA, 1174 bp, Mus musculus
atgggatctctgcttttttcttggaagggcacacagcagaaagacgttactatcaagtcagatgcgcctgacaccctgttgctggagaagcatgccgattatattgcttcctatggctcaaagaaagatgattatgaatactgcatgtctgaatacctgagaatgagcggcgtctattggggcctgactgtgatggacctcatgggacagcttcatcgcatgaaccgagaagaaatcctggtgtttatcaagtcgtgccagcatgagtgtgggggaataagtgctagcattgggcacgacccccaccttctgtacacgctcagtgctgtccagattcttactctgtatgacagtgttcatgttatcaacgtagataaggtcgtggcctatgttcagagcctacagaaagaagatggctcctttgctggagacatttggggagaaattgatacaagattctcattttgtgcggtggcaactttggctcttttgggcaagcttgatgctattaatgtggaaaaggcgattgagtttgttttgtcctgcatgaactttgatggtggatttgggtgcagaccaggctctgaatctcacgctgggcagatctattgttgcacaggattcctggccataactagtcagttgcaccaagtgaactccgacctacttggttggtggctttgtgaggcgcagttgccctcaggcgcactcaatggaagacgcgagaagttaccagatgtgtgctattcatggtgggtgttggcctccctaaagatcatcgggagacttcattggattgtcagcgaaaagcttcgaagtttcatcttagcgtgtcaagatgaagagacgggaggatttgcagacagaccaggagatatggtggatccctttcataccttatttggcattgctgggttgtcacttctgggagaagagcagatcaagcctgttagccctgtcttctgtatgccagaagaggtgcttcagagggtgaatgtccagcctgagctagtgagctagtcagatgggagagatgctgtagtgtgcaatatgaattactgctgtatttgaagtgtttatcaaacctagacgtgacttaatattttgtatatcatatgttaatgataaattatataagtattgtaaaataaatatgttgtatttagaggaattc

SEQ ID NO: 464 - DNA, 2384 bp, Mus musculus
gctcgccgggagggaaaagaaaaccccgaagccggtcgcgccgccgtcgggccggagggggatatgttcgaggacgagccccacgccgagggggcggcggcggtcgccgcggccagggaggcgctgcaggccctgtgccaggaactgaacctggacgagggaagcgcggccgaagccctggatgacttcacggccatccgcggcaactacagcctagagggagaagttatacactggctggcatgctctttatatgttgcttgccgcaagagcatcattcctactgtgggaaagggcgtcatggaaggaaactgtgtctcactcaccagaatactgcgctcagctaagttaagcttaatacagttttttagtaaaatgaagaaatggatggacatgtcaaacctaccacaagagtttcgtgagcggatagaaaggctagaaagaaattttgaagtatctactgtaatttttaaaaaatttgagcccatttttttagatatctttcaaaatccatatgaagagccaccaaagttgccccggagccgaaaacagaggaggatcccctgcagtgttaaggacctctttaacttctgctggacactctttgtttacaccaaggggaatttccgtatgattggtgatgatttagtaaactcctatcatttacttctgtgctgcttggacctgatctttgccaatgctataatgtgcccaaatagacgagacttgttaaatccatcatttaaaggcttaccatctgatttccatgctccggacttcaaagccgcagaagagcctccgtgcatcattgctgtactttgtgatctgcatgacggacttctagtagaagcaaaagggataaaggagcattactttaagccatatatttcaaagctctttgataagaagattttaaaaggtgaatgcctcttggatctttccagctttactgataatagcaaagccgtgaacaaggaatatgaagagtatgtcctaactgttggggacttcgatgagaggatctttttgggagcagatgcagaggaggagattggaacacctcgaaagttcactgctgacaccccatttgggaaactgacatcacaggccagtgtggaatgcaaccttcaacaacactttgaaaaaaaacggtcatttgcaccttctaccccacttactggacggcggtatttacaagaaaaagaggcagtcaccacgcctgtagcttcagccactcaaagtgtaagccggttacagagcatcgtcgctggattaaaaagcgcaccaagtgagcagcttctgaatatttttgaatcttgtatgcggaatcctatgggaaacattataaaaattgtgaaaggaataggagagactttctgccaacactatacccagtccacagataaacagccaggatctcacatagactttgctgtaaacagactaaaactggcagaaattttgtattacaaaatactggagactataatggtccaggaaacacgacggcttcatggaatggacatgtcggttcttttagagcaagatatatttcataaatccttgatggcttgttgtttggaaattgtgctctttgcatatagctcaccccgtactttcccgtggattattgaagttctcgatttgcagccattttatttttataaggttattgaggtggtgatccgctcagaggagggcctttccagagacatggtgaaacatctgaacagcattgaagaacagattttggagagtttggcttggactaataattctgcactgtgggaggctctgcatgcttctgcaaacagagtcccttcctgtgaagaagtaagccagggctagacgaagagaataagttttgtttttcgagagagggtttctttgtgtagccttggatgttatgaacgatgctctacacaagttcaagccagatgtgtcctagcactgagagggggaaatggaaggagtcccacccaccccaaattatcagattatctgcagatgatgactattgccaaagaaaaatcagttttccccaccggagtctcatttgtatatcaagtacatttcagggcagaccccatgcccagcagtagttggttaacacaaaactcattggtatttttatagactgtttcattttgctttgttttactggtcttttacatgttcatttttgtttttgagcgtgcgtgcgcttgtgtgtctgtgtgtctcttgtttgatttaaggaaagaaagatcttgagtgagtaggaagatggatagggtccgagaggaattggaggaggggaaaacttgatcagaatatattgtatggaaaaatttttttcaataaaaaaggaatgatgttgctatgaaaaaaaaaaaaaaaaaaaa

SEQ ID NO: 465 - DNA, 388 bp, Mus musculus
gtttgtttaaagaaacatagctatgagttacaagactacgctatgatatgcaagttcaaaaactgactcttggagcctaaaaggatgagaggagttgaaagttcagcaggcaattcaaccaagtgttttgggttttttttgtttgttttcttgagacaggtttctttgggtagctttggttgtactagaacaggctggcctcgttccacctgcctctgactctcaagtgctgggactatttaaaggcatttgccaccatcacccagcttcaacagtcttttaaatgccgctcttgacaagaaacttttaatcttaaaacaaaatacctcccaaatcaaatgataatgcacatcagcacccaagctgccctccacgcacgcacaattcc

SEQ ID NO: 466 - DNA, 636 bp, Mus musculus
  modified_base (187)..(187): a, c, g, t, unknown or other
tctacttttgtttaaaatagatccatggtttgcgaccttgcagggttagcggatcttgatcctagcgctgcaagtgttttcccatcacttggatattcagtgcacaacaccaagccttttgtggtctatgggttgtgtgggtgcagactctgctccttcaccttactactgagttcatttctctganccgcatttccactttgtatcttcatgcatttattgatcaattattaacacaaaatgaatcaagacgtgaactgctgtaaacatagcatagagcaaagtatcctggaaacgatgccattcaaacaatgggaggtaaaggagacagacaataagtggaactggattctagtaggtggttgtaggtgctatagtaggtggttgtaggtgctacggagagaacttaggtgaggaagaaggatggacacagatgagacctgcagaccattgaacaaaggcatgcaggagtctttgcatgcttcttcagtgtgactgtgtgcttatcctattgacgctttgatcgatgctaacttttttgttatattagcagttctgttttatccccattccttctcatggcatattctatttttctgtttggactcttattttaaatttttatatgccttttcc

SEQ ID NO: 467 - DNA, 3607 bp, Mus musculus
cacagtagtggtctatgccaagagggtcgcgatgggggtcccagggggtagggcagcaccttaggctcaatcgagtcgcccctgctatctttccgaagcaggcacagattccgttcgcaggcttcggcatggcggaatctgagtcactggtgcccgatacaggtgctgtgtttacgtttggaaaaactaaatttgccgaaaatattcctagcaaattctggtttaaaaatgacatacccatatgtctttcatgtggagatgaacatactgctattgttacaggaaataataaattgtacatgttcggcagtaacaactggggtcagttaggattaggatcaaaagctgctatcatcaagccaacatgtatcaaagctcttaagcctgagaaggtgaaacttgctgcctgtggaaggaaccacaccttagtttcaacagatactggtggcgtatatgcagctggtggaaataatgaaggtcaactggggcttggtgacactgacgatagagacacctttcatcaaattgtcttctttacacctgctgataccattaaacagctctctgctggcgccaatacatccgctgctcttactgaggatggaaaactttttatgtggggtgacaattctgaagggcagattggtctagaagataaaagtaatgtatgtatccctcatgaagtgactgttggaaagccaatttcctggatctcttgtggatattaccattcagcttttgtaacaatggatggggagctctacacatttggagaacccgagaatgggaagttgggccttcccaatgagctgctgatgaatcacagatcaccccagcgtgtgctgggcattcctgagagggtcattcaagtggcctgtggtggagggcacactgtggttctcacagagaaagttgtgtatgcctttgggctggggcagtttggacaactgggccttggcacttttctctttgaaacatcagaacccaaaattattgagcgtattaaggatcagaaaatatgtcatatttcctgtggagaaaaccatacagctttgatgacagaactaggcctcctgtatacttttggagacggccgacatggaaagttaggacttgggatggagaatttcaccaatcagttctttcctaccttgtgctctaactttttgagatttgcagttcaattgattgcctgtggtggatgtcatatgctagtttttgccactccacgacttggtacaatagatgaacctaaatttgaagacgtatatgagccttatataagtacaggttctttttccatcaatgacctctccccaagaagttcactgaatagatctttatcagcacgtctgcggcgaagagagcgggagagacccccatgctcagcttcaatggtgggaacactgcctccattagaggggacttctgcctccacttcagcttatttttaccccagttcaccccccttccatttgtctgtgaataactacccagagaaaagcccctctgaatcaatggagccactggactcagattattttgaagataaaatgaacaaagacacagagacagaaaattcttcagcagtggattcagaaaactttggtgaaactaatgatatcttaaatatgacacatatgatgactacgagttccaatgagaagttattagatttttcaccaattcaaaaacaacagaatcaagacacatttgagaaagtgatggaaagtacaccgtgcactgaaaatgaggatagttatgaatatgaagaaatgtcaaaaataaaagaagtgacagtgtacaaacaatatttagcaaaagggatctacatgatacgaccagccgagattctggaagcattttcagatgaggaagtgggtaatggcctagaccaggtggaggagccgcgggtcttcactgatggaaagggcttacaaagcaggcaagtaggaaaggaaagtgatgaagaaatagtctctgagaagaaaactgaggtgatggaagtggcagatgtgaaaaagattagagaaagtgaagagaactcaaaatcagattcactttttgatgacttaccagataaaaccatgaattctgagagtgaagacaataaagatattgctgaggaaaggagaagcagtgagcagaatatgacctttgacagtgaaacagaattggtagaagaaccagacagttacatggaatgtgagaggcacaatgagcaagacagtgctgaggagttggagcagcccaagctagtagaatatagtagcgaagagaaagatgagaaagatgagaaagatgacgatgaagtggagactgagaacttatggtacgacaggaactgtactgagcaagaaactgagaatgtattcagagcaaccagatttttcccaaagttcgatcttaagcatgatcatttgtcagggataccagaggagcaggaaggaccagaggattcagaaggaaatgtagtagtggagcaagtagtacaggcacaaaaggaaaatttggaatttgaaggagacagaaaggaggcaaaagcagaagccccatcagatgtcattacagaaaaagaggctcctcaactttcagaaactgtgaaaccagaagaaggggaaatggatgaggaaattagtatcctgaatgtagaagacactgtagaagaagaaaggaaggaaggagagaaggagattgtagaagaaggaagtatacctgaaacagaaggctcagaaactattgatattactgatgagaagctagatgaagtccttaaagaggaagacagtgccagccttctgcaacgggcccttcgtgagtacaatgaaaatccaaaaggacacatgtatgatcgtgtaaagagcagctcttcagaaattctgggaggtaatgatccaacaagtaaagacataaaaaaagctaaaaaaatttccttctttaatcggatgtcattgacaggtcagaaactgatgcagaatactaatgatccactcccagagataaagccaataggagatcagatagccttacaaagtgataagaaagatgccaaccagaaccacatgggtcaaaatcttcaggattcgacaacaccaaatatggagggaaagtccaaatcctgtacaattctataaatgcatgtttatgtttcaatggtcaccgagcacatttgttcttcatacttgaaaaatggtgtgacttctgaagaaaatcccctgacaacactgtttaaaaaggtataaattagtatgtttggcttggtttgaacaatatgaacagttttaatatttatttatgttaatattcttaacagtttccaaagtatgtgtacctccaactctctttgaagtgttctggccttacaactgctcagtgttgcataaaacaatctatttttatatttgaaagacgaatgaagctatttcatagttttgccaacacagttattgtactttgtaatttcctaagacaatgttcacaatattacgacactggaacagttttgagtatatttacaacatttaaaaacagggaccattgtaatgaacttattttaataaactatgtctggttggttctgctgtgaaaaaaaaaaaaaaaaaaaaaa

SEQ ID NO: 468 - DNA, 497 bp, Mus musculus
ggtccgcggtggaccaaggcgcccagtggagtcgcgaagtggctggcgatggccgcggagaggtgcacatttgcatatcaagttggacctgttgcatttcatggattcagcagtcctacgttgccactggaccatgaggaggcagaaggaaaatcaagtgggttccatctgcagtggtttttaaaagggcaagaagaaaaacaacagacgctgtcacctggatcctggcttcacattccaaaccagaacattactttctttccagtgttgtggttacaaacagttttgttagaatggctttcattccgtatcactcactgccccactgaaagtgtacctttccagaccgggagctggctgaaggagtttgctgcaaaacttgatgaccttactttgattccaagctccactgactctgcaaagttgcccccagatcaccatggttctcatgtccccagcctcccaaataaataaattttaaaagtaaaaaaaaaaaa

SEQ ID NO: 469 - DNA, 2074 bp, Mus musculus
gtttagtggagctccggcctctgcgcgccaagtttgggtttcccccggacgtggtgtgtcacgtggtggggaggctggttcccggagcacgtgctgggctgttaggacagcccgctgcggggttccggctggaggtgttgctgtggtcactttccgcgcgctctccaggaattcggcgatccacttgcctctgcctccctagtgctgggattaaaggcgtgcgccaccacaacgcgtttagtccctttcataaagaccggaggaacagacgtttacggccagctcccgaaaccaagtgaactggaggccaccctgcaccaagggttggaaccttttcacaaaatccacgctcctaatacaaggcaactctgaaccagtgcaatggcagacagggatgccaccctgtgggcttctcatgagaagatgttgtcgcagcccctcaaggacagtgatgccgaggtttacagcatcattaaaaaggagagcaaccggcagagggtcggattagagctgattgcctcggagaattttgccagccgagctgtgttggaggccctgggatcttgcttaaataacaaatactctgagggatatccaggccaaaggtattatggcgggaccgagttcatcgatgagctggagatgctgtgtcagaagcgtgcattacaggcctaccatctggatcctcagtgctggggtgtcaatgtccagccttattcaggctcccctgcaaactttgctgtgtatactgccctggtagagcctcatgggcgaatcatgggcttggacctgccagacggtggccatctgacccatggcttcatgacagacaagaagaaaatctctgccacatctatcttctttgaatccatgccttataaggtgtacccagagactgggtacatcaactatgaccagctggaggagaatgccagcctcttccacccgaagctgatcatcgcagggaccagctgctactcccggaacctggactacgcacggctgcggaagattgcggatgataatggggcgtatctcatggcagacatggcacatatcagtgggctcgtggcagctggggtggtgccctccccctttgaacactgccatgtagtgaccactacaacccacaagaccctgagaggctgccgtgctggtatgatattctacagaaagggtgtgcgcagtgtggatcccaagactggcaaagagacttactatgaactggagtccctcatcaactctgccgtgttcccaggccttcaggggggtcctcacaaccatgccattgctggtgttgctgtggccctgaagcaagccatgactacagaattcaaaatctaccagctccaggtgttggccaactgcagggctctgtctgatgcactcacagagctaggctacaaaatagtcacaggtggctctgataatcacttgatcctaatggatctgcgttctaagggtactgatggtggaagggctgagaaggtactagaagcctgttctatcgcctgcaacaagaatacctgcccaggtgacaagagcgcgttacggcccagtggactgcgactggggactccagcattgacatcccgaggacttttggaagaagacttccaaaaagtagcacactttatccacagggggatagagttgacactgcagattcagagccacatggccacgaaggccacactgaaagagttcaaagagaagctggcaggagatgagaagatccagagtgctgtggcaactctccgggaagaagtggagaactttgcttccaacttctcactacctggccttcctgacttctgacaggaacagcctgtgtttgccaagagggtaggattgttccgggaccctgtgaaccctgtgccctcttgaggctgagaagtggaccactgagctgtaccatgctttctttggtgggtgtttctgtttacctgttttcaaatattttgggaacaggttattaaggacttgaaatttgaaacgttatgtagccattagatctcctcgctcatgcatgtgaggcaaagctattaaagattccagaattgtcaaaaaaaaa

SEQ ID NO: 470 - DNA, 384 bp, Mus musculus
attaattatccccccgcgccttgaacccgagaaccctgtagaaaccgctacccagatctaaacggacagagaactcctttcttaggcaccaagtgttggagactgttctacatgtatcaatttccctgggctcactttcccagtgagctcctctttcctccctactctgataggattggaaaacggcccaacacaaaggagggctctgcagcagcccaaacctatcggttttcccctacatttgaaaattttaattcatttcatattattctcaccaagtaagctactacaatcaaacacagtttcgatatcaccaattcaggtgccaaacgatcctgtgccattgctctgtaagtaaaagaattaagcaaatgataggctacc

SEQ ID NO: 471 - DNA, 1166 bp, Mus musculus
gggggtttctcggccgcgcgcggctggccggcgcgcctacgcgcgtgagagagagtcctgaaggagaaggttgcggccacgcgcgggaaaaggcggctctcagtgaccgttaccctttcggtttccacgggagacgccggaaggggaggaagaagtggaacggacccccttctcaaaatgggggagccggcgactctaggttgcagtgtgtgctgtaaatcttcttggaatcaactgcaggacctgtgccgactagccaagctttcttgtcctgcccttggtgtttctaagaagaatctgtatgactttgaagttgaatacctgtgtgattataagaagatccgtgagcaggagtattacctggttaagtggcgtgggtatcccgactcagaaaacacctgggagccacggcagaatctaaaatgtatacgagttcttaagcagttccacaaggacttagaaagagagcttgtccgacgacaccgccggtcaaagccacccaggcatctggacccaaacctagccaattacctgtgcagagggccaagcagaggcgggcacttcagcgttggaacaagagctcaatgccaagcgcagccacctggggcggatcaccgtggagaatgaggtagacctggatggccctccaaggtcctttgtctatatcaatgagtatcgagttggtgagggcatcaccctcaaccaggtagctgttggctgtgagtgccaggactgtctgttggcacccactggaggctgttgccctggagcatccctgcacaagtttgcctacaatgaccaaggccaggtgcgactgaaagctgggcagcccgtctacgagtgcaactcccgctgttgctgtggctatgactgcccaaaccgtgtagtccagaaaggcatcagctacgatctctgcatcttccgcactaatgatggccgaggctggggtgtccgcacgctggaaaagatccgaaaaaatagctttgttatggagtatgtgggagaggtgagcatatgggtctgagtatgtgtgcagctttccccactccctgtttgtagtatgtgtgcccctaaccctgtacctcaaactcttctgctttcctgtaagaaaagcctatggtgttggtctgagtattacagggacatagttaaaagaacactgaagc

SEQ ID NO: 472 - DNA, 435 bp, Mus musculus
gctgacatgactctggagcagaaggtagacacagagaccccgaggcctgttggagctgactttgattcacggttgcctgtacgttatctttgaggaagtcaagggccagccttttcctttggtagtctccttttctgcttgacaaggttggaccttcctagccagttgctactccctgtaaaccctacagaaaccagtctcatcttttctccttcagacaaaagaaattgatgagctgacccgaatctgtgatgacctcatctctaagatggaaaagatctgagcacagccaggctataaccatgcgctcttctttctgtctacccatttatttccttatctgtctgatttatctcttacgtgtggtttagtttaacctctgttcatttctaaattactttattttgaaaagactaaatgtttaatctcaaactc

SEQ ID NO: 473 - DNA, 442 bp, Mus musculus
tgttgatgaacagcacatctttacccagttactaatgatacatggatggttctagaatgctcatctgattcctcccatgttcttatgcagggctggatgacatttgagaacggtaacctggatggacagcaaaggaatcaaatcccttaaataagaatttatttgacttaatttataaaaataaataattatatatagttaaaaaaaaagaaccttttatatagtttgtatgaagtcagcatgtattttgggtctggagtttctagtgttttatttcaatttgtacttggttgaatgaggctagctcctgctcttccttcctcttgctttgttttctcttctctttgctgtttcaccccagctaactgcctgtgtaacctgtaagagagatttgtggaattaggctggtgcatgtagcaaaataataaaagcaagtgaatgt

SEQ ID NO: 474 - DNA, 598 bp, Mus musculus
aagacagggtctgtctagatagccctggctggtctgtagcatgccagggactagtctggcctcaaactcagagatatacacctgcttctgctttccacgtggtaggacaagaggcatgtaccccaatgcccagccctgctctggaattcataacaagggaaggagagatttttactgggccgttgcccatttcctttacttcagatcctcaataatctgatactttaaacttgcagttttaactggaaacgaccctactgtacctcaaagaatcccaggaaacaacctgggatttctccctaacttcctgcaccactgcatcagggcttcctagttttacttgaatctggtttaaggttttaaaaggagatactcagggcccatttagagtccagttcatctctctgcagaaacaagctagatctgcatatatgaaataaaaggatcttgaaatggtttgcatgggccgaatctacttggcctttgttagtacaatgtgaaaaaagaaaatctatcctaggttattgaagaaagccaacaaaaggtgcagaaatgaggaccacggacagagaagggagccacggtgaggtcatcacac

SEQ ID NO: 475 - DNA, 417 bp, Mus musculus
tttgaagaactaagttattctgtgaatggatctttagtgattgttagagcaggggaaattacttttgcagaaaaggttgcaaatgccccaagctttaatgcaattggtgtcctcatatacatggacaagaataaattcccccttgttgaggcagaccttgcactctttggacatgctcatttaggaactggtgatccatacacacctggctttccttctttcaatcatactcagtttcccccatctcagtcatcagggttgcctaatatacctgtgcaaacaatctcaagagctgctgcagaaaagctatttggaaaaatggaaggaagctgtcctgctagatggaacatagattcttcatgtaagctggaactttcacagaatcaaaatgtgaagctcattgtgaaaaacgtactg

SEQ ID NO: 476 - DNA, 417 bp, Mus musculus; identical to SEQ ID NO: 475

SEQ ID NO: 477 - DNA, 684 bp, Mus musculus
  modified_base (83)..(83): a, c, g, t, unknown or other
atccatctcccggactcattttgaggatttttttttaaaaagggactcccgcaactttttttttatcaggattaatgggttantggtagtgtcttttaataattgatatttgaagataataatgattaaaggttaatatgaaaggaatgagataagaatacaaaacgcagttaaagtaaaatagatcgaactcaaatgatacttttagaaaacaaaaaataaaaacatggcactttaccaggtattggtatgacttaaatgattagatagtcagtggaagaagaggctataaaatgttaaaatgcctaattgcaatgtggactaaaaagaattagaagataaattgggtttatttgttgtctaaaactacctgatctcattgtttctctgaatgcctcagtatatcatttttatcctatattaaacatcatacttttatgcaaaatagcagttcacattcttttcaccttactgggaattattcatttctggttgtctgatttgatacgtagcaatctttgaaaaacagagtcttgacatgtaactcaggttagctttgatcttattggcctagtcccccaataatcagtgccaaagttttgggactacaggtatgagtcacaatatctggttcaaaatttgtgaattttattctcagttttaaatggttacatattaacaccg

SEQ ID NO: 478 - DNA, 756 bp, Mus musculus
ggaaccgtctcgtagcttgaggtctgggcgggagcggccgagtggcgcgaggagccgttaccagagccggagcctccggttaagcctgatcacgatgacaacctcccaaaagcaccgagacttcgtggcagagcccatgggggaaaagccagtggggagcctggccgggattggtgacgtcctgagcaagaggctggaggaaaggggctttgacaaggcttatgtggtccttggccagtttctggtgctaaagaaagatgaagacctcttccgagaatggctgaaggatacatgtggtgccaatgccaagcagtcccgggactgctttgggtgccttcgagaatggtgtgatgccttcttgtagtgttctctggggatccctcataccccagccacagcacagtttccagagtctgcagcagggcagggctcctccctgtcctccataaaggaaaagatggctgttgtcaccctcacctcctatgtactccagggtctatggggagttctctcccctcagcgtttcaatctttctgggatcgtttcccttgcatgcctttcccttccacctccccctgcagttccgtggcagcagttaccaactttcctgaatggattcctggcccccttctccctcactatctgttggatgccctttggctcctttcctttttttggcaaaaacagtcactgtccttataaaagatttttaaattaataaaatcagtggccttcaaaaaaaaaaaaaaaaaaaaa

SEQ ID NO: 479 - DNA, 756 bp, Mus musculus; identical to SEQ ID NO: 478

SEQ ID NO: 480 - DNA, 756 bp, Mus musculus; identical to SEQ ID NO: 478

SEQ ID NO: 481 - DNA, 3046 bp, Mus musculus
cggagcctctggactttcagttctgttttgcctgccctgtggctcctgccagctctgatgccaggctccgttccccttgcagacccctgtgggcggcgcttgccgcaccgggggcggtgctggcgaccgggaagttcggggccctgacctggggacatccccttccctcacttccaggtcttcagtcttcctaggctggtgcccagatggctagtgggcacggggagcggcggctggaggactcctaggctccgggcaggcggtcactggcaggagatgtgtccgcaatcatagtttctgatggtgaaggttggacggcagtctctgcgacctagaagtggaaaagatgtcgttcaaggaggtgcggactgtttccttctgaccaggatcttgtttctgagtgtaggggcttcacttctctgcttttcgttcatctctggagcatccgaattgcatcaccggtcagaaaacaacttaccgaaacctcagacaaagcgtcaaatctcagaggatgctacgagctctttggctcttctggatcttggtggccataacagtcctcttcagcaaacgctgttctgctcaggagtctctgtcatgtgatgcttctggggtgtgtgatggccgctccaggtctttcacctctattccctccggactcacagcagccatgaaaagccttgacctgtctttcaacaagatcacctacattggccatggtgacctccgagcgtgtgcgaacctccaggttctgattttgaagtccagcagaatcaatacaatagagggagacgccttttattctctgggcagtcttgaacatttggatttgtctgataatcacctatctagtttatcttcctcctggttcgggcccctttcctctttgaaatacttaaacttaatgggaaatccttaccagacactgggggtaacatcgctttttcccaatctcacaaatttacaaaccctcaggataggaaatgtagagactttcagtgagataaggagaatagattttgctgggctgacttctctcaatgaacttgaaattaaggcattaagtctccggaattatcagtcccaaagtctaaagtcgatccgcgacatccatcacctgactcttcacttaagcgagtctgctttcctgctggagatttttgcagatattctgagttctgtgagatatttagaactaagagatactaacttggccaggttccagttttcaccactgcccgtagatgaagtcagctcaccgatgaagaagctggcattccgaggctcggttctcactgatgaaagctttaacgagctcctgaagctgttgcgttacatcttggaactgtcggaggtagagttcgacgactgtaccctcaatgggctcggcgatttcaacccctcggagtcagacgtagtgagcgagctgggtaaagtagaaacagtcactatccggaggttgcatatcccccagttctatttgttttatgacctgagtactgtctattccctcctggagaaggtgaagcgaatcacagtagagaacagcaaggtcttcctggttccctgctcgttctcccagcatttaaaatcattagaattcttagacctcagcgaaaatctgatggttgaagaatatttgaagaactcagcctgtaagggagcctggcctcctctacaaaccttagttttgagccagaatcatttgagatcaatgcaaaaaacaggagagattttgctgactctgaaaaacctgacctcccttgacatcagcaggaacacttttcatccgatgcccgacagctgtcagtggccagaaaagatgcgcttcctgaatttgtccagtacagggatccgggtggtaaaaacgtgcattcctcagacgctggaggtgttggatgttagtaacaacaatcttgactcattttctttgttcttgcctcggctgcaagagctctatatttccagaaataagctgaaaacactcccagatgcttcgttgttccctgtgttgctggtcatgaaaatcagagagaatgcagtaagtactttctctaaagaccaacttggttcttttcccaaactggagactctggaagcaggcgacaaccactttgtttgctcctgcgaactcctatcctttactatggagacgccagctctggctcaaatcctggttgactggccagacagctacctgtgtgactctccgcctcgcctgcacggccacaggcttcaggatgcccggccctccgtcttggaatgtcaccaggctgcactggtgtctggagtctgctgtgcccttctcctgttgatcttgctcgtaggtgccctgtgccaccatttccacgggctgtggtacctgagaatgatgtgggcgtggctccaggccaagaggaagcccaagaaagctccctgcagggacgtttgctatgatgcctttgtttcctacagtgagcaggattcccattgggtggagaacctcatggtccagcagctggagaactctgacccgccctttaagctgtgtctccacaagcgggacttcgttccgggcaaatggatcattgacaacatcatcgattccatcgaaaagagccacaaaactgtgttcgtgctttctgagaacttcgtacggagcgagtggtgcaagtacgaactggacttctcccacttcaggctctttgacgagaacaacgacgcggccatccttgttttgctggagcccattgagaggaaagccattccccagcgcttctgcaaactgcgcaagataatgaacaccaagacctacctggagtggcccttggatgaaggccagcaggaagtgttttgggtaaatctgagaactgcaataaagtcctaggttctccacccagttcctgacttccttaactaaggtctttgtgacacaaactgtaacaaagtttataagtaacatagaattgtattattgaggatattaactatgggttttgtcttgaatactgttatataaatatgtgacatcaggaaaaaaaaaaaaaaaaaaaaaaaaaaaaaaaaa

SEQ ID NO: 482 - DNA, 689 bp, Mus musculus
  modified_base (43)..(43): a, c, g, t, unknown or other
ttatggcaagtttctcgggcttagagcatttatccgaaaacanattaacaatatttttctaaggtttgtttatgaaacagaacacttcaatggtgtagctgaactgctggaaatattaggaagtattatcaatggctttgctttaccactcaaggcagaacacaaacagttcctggtgaaagtgttgatccctctacacactgtcaggagcttgtcactctttcatgcacagctggcgtattgtatagtacagtttctggagaaagacccttcccttacagaaccagttattagggggctaatgaaattttggcctaaaacatgcagtcaaaaagaggtcatgttcctcggggagctggaagaaatcttggatgtgattgaaccgtcacaatttgttaaaatccaagaacctttgtttaaacaaattgccaagtgtgtttctagcccccattttcaggtggcagaaagggcactctattattggaataatgaatacatcatgagtttgatagaagaaaactctaacgtcatccttcccatcatgttctccagcctttataggatttcaaaagagcattggaatccggccattgtggcattggtgtacaacgtgttgaaggcatttatggaaatgaacagcactatgtttgatgagctgacagccacatacaagtcagatcgtcagcgtg

SEQ ID NO: 483 - DNA, 2837 bp, Mus musculus
tcctctctccccaccacaacccaatgatctctacaagaatgccaccagttccagtgaattctacaaggcccaagggccacctccaagccaacatagtctgaagggcatggaacaccgaggtcccccgccagaataccctttcaagggcgtgccatcccagtctgtagtgtgcaagtcccaagagccagggcacttctatagtgagcatcgcctgaaccagccagggagaacagaggggcaactgatgaggtatcagcacccccctgagtatggggcagccagggcaacacaggacatctactcgctgtctttgtcagccaggaactctcaacctcatagccctacttcttccctgacagctggggcttccagcttgcccttgctgcagtctccgccgtccactagattgcctcctggtcaacacctggtcccgaaccaaggtgaccactctgctcacctgtcaaggcatcagcagcatcttctttcgagtcagagtcatcagggggaccactaccgtcacgcccaggccagcctgacttcagcgcagcagcagccaggagaagcctactcagctatgcctcgggctcagcagtctgcttcttatcagcccatgccagctgacccttttgctatcgtctctagagctcagcagatggttgagatcctgtctgatgagaatcgcaacttgcggcaggagttggatggatgctatgagaaggtggcgagactgcagaaggtggagacagaaatccaacgggtctcagaggcttatgagaacttggtgaagtcatcttccaaaagagaggctctggagaaagccatgaggaacaagctggagggcgagattagaaggatgcatgacttcaacagagatctgagagaccgtctagagactgccaacaagcagctggcagagaaggagtacgaggggtccgaggacaccaggaagaccatctcgcagctctttgccaaacataaattttgccaaccatacaacccagcggaaagaaaagtgaagtacgtggtggccgttttaccattgagcccaaaggggaccattaaaatccgagccagggcattgagcaatgcccaggcgaagtggaagctggaagaagagctgaaaaagaagcaagtgtacgtagataaggtggagaagatgcagcaggcccttgtgcagctccaggccgcctgtgagaagcgtgagcagctggaacaccggctccggacacgtttggagagggaactggaatcccttagaatccagcagcgccagggcaactcccagcccactaatgcttcagaatacaatgccgctgcactgatggagctcctccgggagaaggaagagagaattctggccctggaagcagatatgaccaagtgggagcaaaagtatttggaagagaatgtgatgagacactttgctctggatgctgctgcaactgtggctgcacagagagacacaacagtcattagccactctcctaacaccagctatgacacagccttagaggcccgcatccagaaggaagaggaagaaatcctgatggccaacaagcgttgcttggacatggaaggaaggattaagaccctccatgcccagattatggaaaaggatgccatgatcaaggtgctgcagcagcgctccagaaaggagcgagaaacagagcaactctcatccatgcggccagcaaagtctctgatgtccatttccaatgctggatcaggcctccttgcacactcctctaccttgactggtgcgcccattatggaggagaagcgtgatgacaagagctggaaggggagcctaggcgttcttctgggaggagattaccgtgttgagccggtcccatccacaccgtcccctgtgcccccgtctactccccttctctcagctcattcgaagacaggcagtcgcgattgcagcacccaaactgaacgtggaccggaatcgaccaaaaccgcagctgtcactcccatctcggctccaatggctggtccagttgctgctgctgcccctgctgctgccatcaatgcaactgctgccaccaacactgccactgctgccaccaacaccactatcatggtagctgctgctccagttgctgttgctgctgttgctgctccagctgctgctgccgccaccccatctccagcaaacgctgctgctcttgccgctgctgccgctccagctacttctgtctctgcagctacttctgtctctgcagctaattctatctctccagctgctcctgtcgctccagctgctgtagtgcctccagctgctcctgtctctccagctgctgctgttcagattccagctgctgcatctcttactcctgctactgtttctccaactgctgccactgctactgctgctgttgctgcagctactactgctgctatcactgctgctgctgctgctgccactactgctattcaggttgctccagctacttcggctccggttccatctccagcttcgattccggctccagcaacggctcaggcttctgctccgactccgactcaggcatcaactccagctccgactgaacctcctagtccagttccaactccaactccagctttggttcaaactgagggtcctgcaaatccaggtgccagttccggaccacgccgcttgtctacaccaaatctgatgtgcaacccagataagccagatgcccctgctttccactccagcactctggaaagaaagacacccattcagatcctggggcaagagcctgatgcagagatggtggaatatctcatctaaacagcacaatcaagagctggcgttatcagcaagagtctttttaataatttttccc

SEQ ID NO: 484 - DNA, 699 bp, Mus musculus
agaggctcagaacaaacagacaacactcaggggccgaactaaatcatcttatagtctattttaccataccctgtttcaccaaagcagaaaaactctcatgtgagccaaggagataaaattaccaagaattccttgagttcgacctcagataatcaggtgactaacttggttgtgccatctgtagatgaaaatgcatttccaaagcagattagtttgcggcaggcccagcaacagcaccttcagcagcaaggaactcgccctccaggcttgtcgaaatctcaagtaaagcttatggacctggaagactgtgcactctgggaaggaaaaccaaggacatatattactgaagagcgagcagatgtctccttgacaactctgcttactgctcaggcatctctcaaaactaaacctatccacacaatcataaggaaacgagctcctccatgcaacaatgacttctgtcgcctgggttgtgtgtgctctagtctagctttggaaaagcgccaacctgctcactgccgtcgaccagactgcatgtttggttgcacttgtttgaaaagaaaagttgtgttggttaaagggggatctaaaacaaagcatttccataagaaggctgctaatcgagatccattattttatgatacgctgggagaggaaggaagggaaggaggaggagtcagagaagatgaggaacaattg

SEQ ID NO: 485 - DNA, 2010 bp, Mus musculus
ggtggcagcgaccgcggcggctgcagcaggccaccatggcagaacttcaggaggtgcagatcaccgaggagaagccgctgttgccaggacaaacacccgagactgccaaggaggccgagttagctgcccgcatcctcctggaccagggacagactcactctgtggagacaccttatggctcggtcacttttactgtgtatggcacccccaaacccaaacgcccggcaatattcacctaccatgatgtaggcctcaactataagtcttgcttccagccactgtttcggttcggggatatgcaagagatcatacagaacttcgtgcgggttcatgtggatgcccctggcatggaagagggggcgcctgtgtttcctctgggatatcagtacccatctctggaccagcttgctgacatgattccttgcatcctgcagtacctaaatttctctacaataattggagttggtgttggagccggagcctacattctgtcgcgatatgctctgaaccacccggacacagttgaaggtcttgttctcatcaacattgatcccaatgccaagggctggatggactgggcagcccacaagttaactggccttacgtcttccattccggacatgattcttggacatcttttcagccaggaagagctttctggaaattctgaattgatacaaaagtacagaggtatcatccaacacgcacccaacctggagaacattgaactctactggaacagctacaacaaccgccgagacctgaactttgagcgaggtggtgagacgaccctcaagtgccctgtgatgctggtggttggagaccaagcacctcatgaagatgccgtggtggaatgtaactcaaagctggaccccacacagacctcgttcctcaagatggccgactctggaggtcagccacagctgactcagcccggcaagctgacagaggctttcaagtacttcctgcaaggcatgggctacatggcctcttcctgcatgactcgcctatctcggtctcgcacagcatctctgaccagtgcagcatccatcgatggcagtcggtcccgatcccgcaccctgtcgcagagtagcgagtctgggactctcccttctggacccccagggcacaccatggaagtctcctgttgaatgaccctcattgccttggtgtggatcccagccctcacctcctgcaacactaacttaagaggtgttatcagggcactgggccagagtaagcaaggaaaatgggcagattgtgcagggagatgaccttgatctttaattgctaccctaaccttgacctttaacctgtgatatcctctagctcctaggtgaggtgtcctaatatctcttagagatctgggccccctaaattaccccctcttccattttggtgttgagaaggcttgtatgttctctctctgacctaggttctatagatgaggaacaatgagctgttctagctgacacggggcctccatcactccccctctttagcccatatttgcaagggtaggagagagagtgtgtgtgtgttgtgtgtggtgttgtgtgtgtgtagggttgatggtgagagatggggagctccttccccaaagctgacagtggctttgccttgatgtgtcaggcctctctgaaggcaatagtcccaaatgaatgtttatcaggagaaggtttgctggtgggtcagcgatccttaatgtgatagaaatatccagcatgtaaaaagaaaggatgggagatggtggcccgtgaagaacagtggtaaacacattgaagctggggtagaagggagggacccaggtcctttggccgcactaacttggatagctgtcagcgtgcacctaaagtgggactaagggaaagagcttaggtctgactgcttggggcttggcatcagggtgggaagagctacctcaggctctgaccatactgtgacgtgtagagcgtgacctcctgtctcacacaacttctgctgtgacaataaactatagaggaaactgaa

SEQ ID NO: 486 - DNA, 350 bp, Mus musculus
cgagaacaagttggactttattagccatccaaccaaccaaacttgtgaattcaagtgataaccctatataagggtaacaatgggttcaacgaaggtattgattctgaagtagtgggttttgattgagttgactgtttttaaaaaactgtttggattttaattgtgatgcagaagttatagtaacaagcatttggttttgtacagacattgtttccactctggtggataagctcaataaaggtcatatcccaaactagctttaaacttgcttaataatcgggacttaccttagatctcactcagcaacaagtacattctctgcttactaattaaacagtgcatctgtagtc

SEQ ID NO: 487 - DNA, 735 bp, Mus musculus
atcctttgtatgtgccaaaatggaatctctttttccacttgattttctttccatgccacttatcttgacatttaattgtgaattctctgttgattctgaatacggttcactggactcatccatcatttcaacattttccaaaccaggcagcagaagcaaaattttctgtttggcttgtcttaatattggttttaattcctcaggataaaccagagctgtcgctttagcaaatgtggcattccacaacagagcactctgtttccgaatctgtttattcttgtgaagaaatattacgcacaggagtggagaaagatgttcaagaagttcactgtcataggctccaagatagctgaactgtaggcatgcaacaatttctcccaatagcttttctaacttgttgttcagactagtatacactttaggagcctcatccagctttgagttttcatacagtaaagccagaggtcttgtaaaagttgcaaatatttctcggatcatagagggcaaggaaatatgtccaaatacattggaaagcatgctaatgatagagttaccaatagcaagcagtgtatcagagaatgtttccttgaggcttagagtgtggaaagtatcgatgactttcacaattagcttaaataaagaagccaatttccctagaggctccttcttctttctggaccaatctgaagatctctgcggtgatttgatttttggctggtatttcttattatatgg

SEQ ID NO: 488 - DNA, 743 bp, Mus musculus
  modified_base (589)..(589): a, c, g, t, unknown or other
  modified_base (703)..(703): a, c, g, t, unknown or other
ttttttttttttttttctaattatagatgtttatttaccatatcttacttagcttaatgcgaaccaaaatgtaccaggaggaggactaagtcatggacattatgtctttgttgacaggtttattattaataaacccgattttaagacttctactgtttagagttatgtactagtttttattagtctgtgtaactgtttcacagttaaaaaaaagagatgcccaaagacagcgttttaagcttaaaaactaaaaacctcttttctacataaatatatcaaactactcaatgtttattatatattaaaattttctgtatttaataaaacttatcatttcagaagcaaatggctattttgcaaacaatctcaccatctttcctgccaacccctctccttttcagcatgcccttaaactatccttttgatcactctaccaagcacccatccattcttttgtttctaccttacaaactattacttccaattatatgaaactcattacacttgaaaatatatttttctcacagaaacaattaacaatttaaactatgttcacttctgtttttgaaagaattggtcatatttttanattttattaacactaataggtttcctagttatttaattacttatggaattaaaaaaataattctttttgccaatagaaaggtctttttgaagtacattttgcactgagtttacnagaaatcctttcttgttccaggtcgctcgaggatgtactc

SEQ ID NO: 489 - DNA, 563 bp, Mus musculus
cttttgcaacccagaagtcattgttcagtatacgttttgatagatatataagaatggactatgacacataagacagctccatgatggtgggacacctgctcccgtgtggatcctatagctagtgtccttcagtccactgcgtgcatggacagcagcagcgcagtgcactccatgagactgtgaactccctcatatgacttctgctaggacttcatcttcgaagaatcacacgtcaaaggagcagatgtggatcacacaggaagccagaatgcagtgttctataggactcttcctggagtcccattctgtgtatggtgaacctatataaagtaggtatgcttcacctgctgtgcgatggtctttagttgtaccttataaaccttataaaccattttatacatttgaaaaagtaaagaaagaaagaaaaagttaagtatgggacattactcagcttcgttggggatcgggactctggtcagtcttagtgattttgaaggagacattaggcaagtttggtaaagaaaacagaaagctcaaaagcaatgggaatggccaaagcaaag

SEQ ID NO: 490 - DNA, 1666 bp, Mus musculus
gaggggagctgttcctgcattttctggagcgagtcttctgactgcttttagttagaactccagtgcccctcggcgggccgcggcctttgaaaatgcgcgcgccctaaacgctgcggcggttacgctgttggcgggagggagctgagcctgcactttccggactaggtgtccagacagctttgagccagcccgtcactttcacctttttacccgagcgtgcgagcgtggacctaacgtgattgctacaatggaaggaattaataatttcaagacgccaaacaaatctgaaaaaaggaaatctgtattatgttccactccatgtgtaaatatccctgcctctccatttatgcagaagcttggctttgggactggggtcagcgtttacctaatgaaaagatctccaagagggttgtctcattctccttgggccgtgaaaaagataagtcttttatgcgatgatcattatcgaactgtgtatcagaagagactaactgatgaagctaagattttaaaaaaccttaatcacccaaacattataggatatcgtgcttttactgaagccagtgatggtagtctgtgccttgctatggagtatggaggtgaaaagtctctgaatgacttaatagaagagcggaacaaagacagtggaagtccttttccagcagctgtaattctcagagttgctttgcacatggccagagggctaaagtacctgcaccaagaaaagaagctgcttcatggagacataaagtcttcaaatgttgtaattaaaggtgattttgaaacaattaaaatctgtgatgtaggagtctctctgccattggatgaaaatatgactgtgactgatcctgaggcctgttatattggtactgagccatggaaacccaaggaagcgttggaagaaaatggcatcattactgacaaggcagatgtgtttgcttttggccttactctgtgggaaatgatgactttatgtattccacacgtcaatcttccagatgatgatgttgatgaagatgcaacctttgatgagagtgacttcgatgatgaagcatattatgcagctctggggacaaggccatccatcaacatggaagagctggatgactcctaccagaaggccattgaactcttctgtgtgtgcactaatgaggatcctaaagatcgcccgtctgctgcacacatcgttgaagctttggaactagatggccaatgttgtggtctaagctcaaagcattaacttgtatgggaactgttaactagatatatgtagttaatataacttatggtagctagattctagaagtagctttaacactagtgacccctgtctaagatgacttaagaatcaagggaccattgctttgttacagatctttttagatattcttgcttctttagtgggttactaaaaatttcactacgtacatgtggtacagatatctgtctgctcatagtgtcagtccttcagctggcctgtcagcccatgcgccctgggacttgagaagagttcataaacgtagctcctagggtgtcttgcctctctacacttagcttctaatttattactttgtttctactgattgtgtcttaagtcttttaaaataaatgtaagaataaacaataaaagacagttttagtaccaggcaaaaaaaaaaaaaaaaaa

SEQ ID NO: 491 - DNA, 2238 bp, Mus musculus
ggcttgatacgtgcgccattttgggcgcttcgctgatggtgtcggtgaacctttttcccgcctgagcgcgactaactgcgggtcttgggcgcctccagaacagcatgttttggaaatttgatcttcactcatcatcccacatagacacgcttctagagagagaagatgtgacactgaaggagctaatggatgaggaggatgttctacaggagtgtaaagcacagaaccgcaagctcatagaatttctgttaaaagcagaatgtctggaagatttagtctcattcattatagaagaaccacctcaagatatggatgagaagatccgatacaagtatccaaatatatcttgtgagttgctcacatctgatgtctcccagatgaatgatagactgggggaagatgagtccttgctaatgaaattgtatagcttcctcctaaatgagtcccccttgaacccactactcgccagtttcttcagcaaggtgctaagtattcttatcagcagaaaaccagaacagattgtggatttcttgaaaaagaagcgtgattttgtggatctcattataaagcacataggaacttctgctatcatggatttattgctcaggctcttgacatgtattgagcctccacaacccaggcaagatgttctgaattggctaaatgaggagaggattatccagaggcttgtggaaatagttcacccatcgcaagaagaagatcggcattcaaatgcctcacaatcactttgtgaaattgttcgcctgagcagagaccagatgttacaagttcagaacagtacagagccagaccccctgcttgccactctagaaaagcaagaaattattgagcagcttctgtcaaatatttttcacaaggagaagaatgaatcggccatagtcagtgcaattcagattttgctgactttgcttgagactcgacggccaacgtttgaaggccatatagaaatctgccccccgggcatgagtcattcagcttgttcagttaacaagagtgttcttgaagccatccgaggaagacttggatctttccatgaactcctactcgagccacccaagaaaagtgtgatgaagactacatggggtatattggacccacctgtggggaatactcgattaaatgtcattaggttgatatccagcctgctccaaaccaataccagcagcataaatggagacctgatggaactgaacagcattggcgtcatattggatatgttcttcaagtacacatggaataactttctacacacgcaagtggaaatttgcattgctctcattctggccagtccttttgagaatgcagagaatggcacaattactgatcaagactccactggtgacaatttgttattgaagcatctttttcaaaagtgtcagttaatagagcgaatacttgaagcctgggacacaaatgagaagaaacaggctgaaggaggacgacggcatggttacatgggacaccttacgaggatagctaactgtattgtgcacagcactgacaagggtccgaacagtgcgttagtacagcagctcatcaaagatcttcccgatgaagtcagggagcggtgggagacgttctgcacgaactccttaggagagacgaacaagaggaacacggtagatctagttacaacctgccatattcattcatccagtgatgatgaaattgactttaaagacacgggtttctcacaggattcctctttacagcaagtgagtcacacctaaagctttgctatttgtttttatcttaaatgcttagtttagctgccccttgggatcagcatctgtcactattagaatgtggtttgggtttgctaccaattaggcaaaatgattggaacagagaggtctgggaccttgccaggtaggctgatactgttgtgttctgggaaacagtgaggaatgatgacattagtgagcactacatgtcacctcacatgctgactgggcaggccttaatggtagtgcatccttacttagattcccggcacagaccttggttaagagggacagaaataagaatgagagcattggagtggattttgtgcagtaatctggaccacgtggtgatctagataatccttccttggtgctctttaactgtgttacatggcatctaaatgaagttttagctgaaagcattcttgccattcctgcccccaaattgatcaactccatgtattgactgcatttttatccttttaacaacagc

SEQ ID NO: 492 - DNA, 638 bp, Mus musculus
  modified_base (3)..(3): a, c, g, t, unknown or other
  modified_base (24)..(24): a, c, g, t, unknown or other
  modified_base (32)..(32): a, c, g, t, unknown or other
  modified_base (113)..(113): a, c, g, t, unknown or other
ggnccagtttcatgaaccgttggntgagtcanagcgggctgcccagtgttacttcaaatacatccaagatttcttttcctgtggggagcccgtggagcccttggaggagagcncagccttccgatacctggcccagtactattttaagtgcaagctgtgggatgaagcttcaacttgtgcccaaaaatgttgtgcattcaatgatacccgggaagaaggtaaggccttgctccgccagatcctacagctgaggaaccaaggggagacacccacctctgacacgccggttcagctttaacttcctggaactgctgagtggaggcagacgctgccagcctctgtgaccgccggaggagggacagcccccctgactgttgtgccgctggctgctgtttggcttcctgcaacagagtttctagctcttcaattttttcatcccgctcctaagagggaaggagagagcacagttgtccagggtcagacaaacgccagaggaccagactaaaagaacctaagcatcctgtccgtaccattcacgctgacgttagcctgcagcacacttcatactgagctcatccctcaacttaaactcaatagctgcacgatactaagggaacctaataaacattaattatagt

SEQ ID NO: 493 - DNA, 633 bp, Mus musculus
aggtattgagtattggtattgaacccgagtcctttggaagagcaaccagtgcccttagctgctgagccttctgtctagcctccagtggaaagtgttttatggttgaaatggtttccttttgtctactttgtaattttcagaaccacatggatttttaaatgcttttattattggctgttttaattgtccttaaagatttatttattgtatgtatatgagtgtttgcttatgttctctgatatgtatgtatgtgttccattgtatgcacctgtatataaggaatcctgaagagatcactgaatctcttggaactggaattagagatacttaatgaggcccccaaatgggcgccgagaaccaaacctgggtcttctacaagagtagccaatgcccttgactgctggtggtctctctagccccttaggctttggtttggtttgtgaagattctctgtttcagccccatctgtcatctctcttcctcctccttagctcctgctaaattgagaagtatgccaggtaatgtttacagaaaggttttttcatttgtgaccctgacctcaatcacctggaagattttatttacccatgaacatcccaagtgtaatatctgctaaaggtgtgattaataatt

SEQ ID NO: 494 - DNA, 601 bp, Mus musculus
gccaatgtaaaaccgggtttcaagtgtcattaatgaagggactcagttgcctagaacactaatttcccttccaaagaagagaacatcgaagtgaaaggtgactcttcccctcttggaccgtggaattcatttcaaattcttgatatcaaacacagtgaaagctaaagagagggagaggatctgggagctgaaaaataaaagagcaaagatttcaaataacgaaaaaaaaaaaatcaagaaaagccaaatataaaaagaaatgttttcatctgacctgctggcagaggatagtaatcttgttcttcattcacttctgcagtcacgaagttttccttaacttcaccgaggttaatcaggagtagttgcttccagaggtcctgtcccagtggcaggaccagcctttaggagtggcgtttatttcatactgttttagctgttctgcagcatcctgaagctttcgttttaggtaatttccattgagagccccttcccgccagtctgccattcgaatcctgagtctgtagagcaggatttgaaaggtggagatggacctgcctcttaaccctgaggattgcaaattactttgcggggggttgccgag

SEQ ID NO: 495 - DNA, 1395 bp, Mus musculus
tgctgcaggcagggttgatcctaggatggaggaagaaatggactgacccaggaactgaaactggttggaccatgagtcacgaataagggagtgtcggttgtaacaacactctttgattatggtctatctatggactatctcacactaagtagactagggactgtgactggacttgtaaatggacacttgtccacatgaacgagagccagaatagctttctaaccattatatggagactgttttcagttaaagtcattgagcctggtacttaccgtcagtgcttgacattcaagacattcttgattcttatttttataaatcaagttctgagaagttaaaaaaaaacctgaatgaaatagtgtcacaatgtaaagaaaaccgtatagatgttaccctgtagtgagttctcttaattttattatggtataaaatggaacagcaggtgttcacaggtactaagtgggttgtgtgccaatatcaccaaagctttcagttccaaccaagttaagttggcttttggctcacttttttttcctattaaaaacttgttacaagaaatggactctgaattcaccaaagactggtgctgtactcacaaaaatcatttggccatgttagaagacacgttttgggaagaagaaatctgggaatataaatctaaaagaaagcccaaacccgtacatccaaataattgttctgaaaatatttcagaatctgttgaaaaatcaacagatggaaaacaccagtcaaaaggaaatgaaaaaaggacttcagaaaatccaggcaagacgaaggaccacaaagtgtgccttgcagaaacagacagtcagatttctgcaggttccagtcagagttcgagctgtagagatgagagtcagcagtctcaaaacaaagagacaacaccgaaaaagcaacatagaactcgcagagggaagcaagtgaccccgaaggtgcgccctgtttatgatggatactgcccaagctgccagatgcccttctcctcattgctgggtcagacgccccagtggcatgtgtttgagtgtttggattctccacctatctctgacacaggtaaggaaagacccatcaaggctcctgccagtgtcccctcagtccccccagggactataggcgcttgcaaccatgactgacttgtttacgtacaggtttgtataggaacccgggtccttgtggacacagcaggcactttgtcgactgagccatcatctcaacttctcagtttccacaaatgtcgctgaacctttctttcactctgctttctcctacttaactcttataaggactatataagttaagtggtattaacactttatagatgagtgttcctacaagctgaataaaccaggcctatttgttatcctactttagaattag

SEQ ID NO: 496 - DNA, 458 bp, Mus musculus
cggtcgccagactttttttgctttaataggctcatcttcattcatttcttccattaactcttgttcttctttaattagcttcttcatgtcttccaatcctttcttatgagggggctcttgaataattttgtcaacatccgcccttccaatcaaatcatcaggccggtcccacatagaaaggcgggtggtgggattgtaaaagaagaccctctcatcaccagtccaaacaacacaccatggagtaccaggaataggagtagtagctactggctttgccttctgggcagccttttcttcttcagtcatctcttcttctttgggctcctcctttatctccttcacaggctcttccttaggatcttcctcctcagtctccattggcaatggctcttcagaggcctccttaattggttctttaatcttctcatccaatttttctttctccttcagttcttggg

SEQ ID NO: 497 - DNA, 686 bp, Mus musculus
ataaaagggttggtttattgtagttcaaatacataaattcaacattcaaacatcttaaactttttagaaacaaaagttcaaacattcaaacaggagtagtttacaggaacacccagaaagggagttttgttgtctaattgagaatattggtagagatcattcaatggagaataaagaatgtttaaaccaggattccactctggccaacatgttagttatgaatgtggttcatacctgagaagaaattactaaatacatcttctcctggggtaaacaagacttggcctataactccggaggggagaatcaaagcacatacgtgaacaaatacaactaaactgctctttagagacaaaggtaaaagtacgtccattataataaccatagtctctggaagaattcaattcagtgttttctcttttacccgcttaaaaaacaaaatcaaaaacaaactccaacttcagttttcctggagtctgtggtatttccaagctcctaccacaaactctcctgtcttgctgagtaacactgctagtaagaacatcaccaagtcactggcttccacaccttataaaaggatgacttttagcttcgagattttaaatttactagagacagcctatatttgagtatgtatgtcagtcatgccacacaaagaaaagcattaactattttcaaagtgttcc

SEQ ID NO: 498 - DNA, 458 bp, Mus musculus; identical to SEQ ID NO: 496

SEQ ID NO: 499 - DNA, 676 bp, Mus musculus
  modified_base (19)..(19): a, c, g, t, unknown or other
  modified_base (147)..(147): a, c, g, t, unknown or other
agacctgctgggtaatgantgtggaagtgtcagggacagacttgtaaatggaatcatggcaagaatagtaagtagcatctggtcttgcaaggctggggaccaaagtcaggagggtccttctgtaaagggaggggtggggaggctganaagggcacaaccagagagtcctcaactatttatcctggaagagacattggggagcaaaagccaaaccctcgaggtgcggatggggaaactgaggcctagattggggatattgacttgtccagggctccgtggtgctgaggcagtaggcaggctccattcctagttcccagccaggacctcggatggtgtcaggttccctttctggtcctaactcactcttggaaaagaaacaaattcacagcccttttcagatgtcagccaagggcaccggctgacacccaacacccaaggacctggacatttgctggtccgctagaggtgaatcagcctcctctcgggcctagagggggtggttgcgtttttctctctctctctctatctctcttgcatttttgtgactctaatgatgaacttatgctaccacgcttttcccttttcttacacaacttacctactaaaggaggaagtgccactttattggtaagtggacgttaaccaagagggacttaaaaaaaaaaatcagaacgtt

SEQ ID NO: 500 - DNA, 1001 bp, Mus musculus
  modified_base (27)..(27): a, c, g, t, unknown or other
  modified_base (33)..(33): a, c, g, t, unknown or other
  modified_base (48)..(48): a, c, g, t, unknown or other
  modified_base (50)..(50): a, c, g, t, unknown or other
  modified_base (112)..(112): a, c, g, t, unknown or other
  modified_base (118)..(118): a, c, g, t, unknown or other
  modified_base (143)..(143): a, c, g, t, unknown or other
tatagtgggaatcataatgaaattgtntgtttnatatgtagggatcgngnatctttcgaaaaaccctgtctaaactgtctgaagagaacatacagaatacgattagcaaccnctaggnaattccagtggatgtacaatcgtgntaacacttatacatgaagactacagttcagtgtatcgttctgtgcttaactcaaagatgcccttaaaaggtatgcaggtgcgttgagagctccaggagaaatggcttcagcacagtatattactgcagctcttagagatttgtttgattccatggataaaacttcttctagtatcccacctattattctgctgcagtttctgcacatggcctttccacagtttgcagagaagggcgaacaagggcagtatcttcagcaggtaaaagggacgggtgtctctcatcttgtaaaaagtttatattatctttgtgtttatatgtaaatgtgggtacacacatgtcacagtatgcatgtgatggtcagaggacaacctctggtgctggtccttgctttccaacttaatacagccactcttgtttttccactgtgccctccaggctggctggcatacaggttctgagggttctctctcctgctagcactgcgattacaaatgcttaagctgcaggtctgactttgacatgggttctgggcattcaagctcaggtccttatgcttggacagcaaggatttcccacttagtcatctctaatccaaggttttctgcactcagtatagtaattggagacacaagtatcagtctgctcttgttcatatcagtatcttgtctagattgtgtataatcttacctggtcatcttgatgttgtttttaatcgatgtatatttgtcacacaggcccaagtgtttctttaaacattcagataagaggaggggtacagctaaatgattaggcacttctttagcatcaatgaagctttgggtttgagttctatacccacaccctcaccccaccctgc

SEQ ID NO: 501 - DNA, 1237 bp, Mus musculus
aagcatgatggacaggatgtttgctcttgagcgtcttgcccgcactgggatcatcgtgaccactagtgaggctgtcctcctacagctggtggctgacaaagaccacccgaagttcaaggaaattcagaacctaattaaggcgagtgccccggagtcgggtctgctttctaaagtgtaggagacttgaaggatcagggtcctccttccctccaggcgatgagactgcaaaccacacaagcccttgtctccactagaactactatgtcaagtcaacagctccttctttgcggctcttagtaacccttacctggctagaccgttgtgtacaagtgtttagttccaatgtcgaggcttcaggtgctgcttctcttcttcttaacgagcttttagttattaagacaaattaccatggaggtgcctgtctcgtctatactgcatactctgaccatatctttccaaagtgcaccctctggtgaagtattcttaaattgtgcactttaatgggagaaaaacaaaaaaaaaacaaacaaacaaacaaaaaaacccacgtaccacaatgatttgacctttcttttgttgtgaagcatcccttgtcatgtcagtgtatacccagtgattttgcttctcaggctgactggccaatgactcctgggtgagaattgagaaccaggactctggctcgtgtatctcctcctctctcagtgttggagtcgctgactgagtgaggtgcattggcttaaggagcgcaaattatcttcaatattgtgtatctgtcttgattgcattaattttcttattcctgttacggtctttgtggatgctcttcctatggataacagtctatgttaacatttttcttccactgaatgttttccttgctccttgtttattttaaacttgtaaacagatgggagtggttgcagtgctggttcattgacagaggttgtcccaaacatacagtctttttgattgcattttttactatacacaggaattggtggagaaagaaacactagttaaaatgtacccatattcccttccaaacattgttatggctgacatcatcaaccagactcataggggtaatactgtggtcattgttaaccaatcaataaacttatttccatttcatttttttaattactcaaacatctttttaatgttttttttgatatgtggaactatgtggaacattactttctttgtataaaattaaagaaaatttataatgtggtgt

SEQ ID NO: 502 - DNA, 520 bp, Mus musculus
tttttttttgcattaagaatgctttatttacattaaaatatgaagaacatttccaataaaacaggaaaaatttatattgtatctacaaaagttctacaatatatgctgtactttaagtatgccaaaaaatctgaggaatgtcatgatcaaccctgtgtagtctgaggccctagccccgaggatgctggtgtttaaattgggcagtcatagacatgaatttcctggtcatctccaacagatacaatttttgatccatttccattatattttactccccaaacctgcaaattaaagaaataaagccataaagccttctaattcctgtatttttttggtaaggaatgcttaaggagtgagtactcttccttctgaatctagactagcccaaggtccacaaggatggagcctaatctctaagtggaccacttcctctggctatggaatagtacttctctctaagataacgacaatcaactaccctttcaaagattcagatccagggtcctgccatgaagtgtat

SEQ ID NO: 503 - DNA, 1509 bp, Mus musculus
  modified_base (23)..(23): a, c, g, t, unknown or other
tggggtttgtggttggtggcaancatggcaccaccggtgaggtactgcatccccggcgaacgtctgtgtaacttggaggaaggcagccccggcagcggcacctacacccggcatggctacatcttttcgtcgctggctggctgcctgatgaagaccagcgagaatggcgcggtaaaggaagcggctacccagcgcgcgttccctctccgggtgccgttgagttccggtccttgggcacaggcaaagcgggcggacgcgtctttggtggctcagccgcagaacgctttggtctcccggctgtgatctctgcgctgtgctgaagcacacccgccgcacacccgttaggttaatctgacttaagttctgtggatgcacacagaaggaagtggagggaaaagcacgcaaatgtaagagtagcccagccagccgagagcttcctcacgtggtacatctcgactacccctccgctttcatgtgtcccacgtcactgacatcaatgtagtaatgctggcgatttccagtgtcttagtgcactaagctcgctcttgtcgcgaacctgtgcgattcacgtgtcgtctatctggaacacactcctgctcaacacctttatttaatcggtttttttagttgtttttttttctctacgaaagcccttctgaccttctgactaaaaaaaagtgggttgtgtgcgcagaaggatcgatatgcccaagaatctccctccagggcacttatttaaatgttactcttgatcactagattctgcccaactagacatttaagtggagccacgattggtggtacaccagcgtatccccagcttctaacaggcacagataaaagcaatcgttgatacatgtaagacgataaaaaaataaataaaaactaaaaccttagacttgtggctcatcagtacagagcttacgtagtatgctgaccctgggaccacagatccaatctcccgaaaaaataaaaactctttaggaactggctagacctaaacatctctctttgtgttgagcttatttgtaaaaacagattccagtctgttggttctggagataaagtcagcctcagcctgtgtgtttagtcactgcatcgatgtctcttgagcactttcaatgtgacctgctcagggctgcccttatttgctactggggatagagtcacgagcccaatacacagcttttcttactgaggaggcggacagaaatcatgagcaaatgtacaaaagaattgtgcggtacaataagaaaatgtaacaggctctgtgcattctagacagtgacaggatttagtcatctgaatataagtagaggtggaggagagcaaagaatgtgatcctcctgtagagaatgggttagacggacactgacatgggagggacttagtaaggtgaggaaaccgcaccaagcaagagaggtaagatggtacttgccagctgccattggactaaaacaagagttgccattctgtagcatttaattgcaagatctgacttatgaagtg

SEQ ID NO: 504 - DNA, 402 bp, Mus musculus
tagtcgatcgcgctccctggagaaatctcaaaggtctggtaagaaggcaagccgcaaacacaagtctaagtcccgatcaaggtagcatactttttaaagtattgtgtctgattttttttctaagttttttgaatttattcaaagttgaaagtgtcctttctctctctctctctctcttttataaactcagtttggtatttattaaatatttttaaataatgttagaaatcctgtataaaagtatttatttatattgcagattttaagtataaatacatttttatttttaaattttgtcttttccctttttttttctttcagatcaacaacccctccccgccgtaagcgctgaggaatgatgtggcaagaatgccatgatgctgtttttaaaaattccatgag

SEQ ID NO: 505 - DNA, 402 bp, Mus musculus; identical to SEQ ID NO: 504

SEQ ID NO: 506 - DNA, 696 bp, Mus musculus
  modified_base (35)..(35): a, c, g, t, unknown or other
  modified_base (49)..(49): a, c, g, t, unknown or other
  modified_base (77)..(77): a, c, g, t, unknown or other
  modified_base (99)..(99): a, c, g, t, unknown or other
  modified_base (156)..(156): a, c, g, t, unknown or other
tgggttttttggaaagggaagaaaggaggcccagntagggtcttcttgnctccaagcccagattgtgctccctccanaaaacccccaggcagtgtggtnagggccccccgtgcctcccgtttgtgcttccttcccagacaggttaatgatacaaanaggttctctgcccgcgcaaggcactcggagaactgcagaggtcctgtgataagtaccccccggctttgttgtgtggggttctgacaccgattgatttaccccttaaggaagggcggtccttcaagtccgctgttgcccggtctctagtgaatagctgaaacgacaggttttctatgttcatttagacctgcctaggaggaagggcccgtccgagctccagactgcccgtgtttccctgtacttggggctgtgaggtggggtgggggagggcttaggttcttaaaaatgtttttgttgttttgttttaatcttgtgtgtttagtttgtgtgcatatgcttgtgctttggcatacggggctccaggacgtactgcgtgagtaatttctcttccttccccgtgttggcctgagggatcaaattcaagttacccggtttggtaccaagcacctgtactagatgggctatctcactaactgcgactagggttttgtttgtttagttgtaaaaatgggagaaggtacctatttagaatagaattcc

SEQ ID NO: 507 - DNA, 4092 bp, Mus musculus
tgcttccggtgtgagcttttgaatatgtcgcgccagctgagagcccctaggtttgaccctcgtgcgggattccacgcggagggcaaggacagaggcccctctgttccccagggcctgctgaaggcagcgagaagcagcggccaactcaacttggcgggaaggaacctcggggaagtccctcagtgtgtttggagaataaatgtggacattcctgaagaggctaatcagaatctttcattcagttctactgaacgatggtgggatcagacagatctgaccaaactcatcatctccagcaataaacttcagtctctctctgatgacctccgactcttgcctgcccttactgttcttgatatacatgataatcagctgacatctcttccttcagctataagagagctagacaatcttcagaaacttaatgtcagccataacaaactgaaaatactgcctgaagaaattacaagcttaaaaaacctgaggacgctgcacctccagcacaatgagctgacttgcatccccgagggatttgagcatctttcctgcttagaagatttagatctttcaagcaatcgtcttgcaactgtgcctgctgattttgctttgctgtccagtctgttgcgactcaatctttccagtaaccagctgaagaatttgccagcagaaataagcagaatgaaaagattaaagcacttggattgtgatgccaatctcctggagactgtgcctcctgatgtgggtagcatggaatcactggaattgctttatttgcggaggaataaattgcgtgttctacctgaatttccttcttgtaggcagctaaaggaattacacctagctgaaaaccagatagagaagttaggggcagagcatcttcagcacctgcaggccatccttgtcctggacctaaggggcaataagctgcggtctgtccctgaggaaatggccctgctgcagtctttggaaaggcttgacctgagcaacaatgatattagtagtctgccctgctcattgggaaatcttcatttgaaattcctggcactagaaggaaatcctctaagaaccattcgaagagaaattatagctaaaggaactcaagaagttctaaaatacctgcgcagcaagatcaaagatgatagaaccaatcaaaatgattctgttcctgagactgccatgacactaccaagtgaagccagagtcaatatccatgccatagccacactaaagctgctagattatagtgataaacaagcaaccttgattcctgatgacctatttgatgccacaaaaacgaccctcatcacttccatcaacttcagcaaaaatcagctgtgcgagattccacaaaggattgttgagctgaaggaaatggtgttggatatcaacctcagttttaacaagctttcatttatatcccacgagttatgcttgcttcagaaattgacatttttagatttaaggaataattttttaagttctttgcctgaagagatgtcatcactgacaaaactgcaaacgatcaatctttcctttaacaggttcaaagtgtttcctgaagttctgtatcgaatctccacactggaagcggttctgatcagtaacaatcaggttggctctgtggaccctcagaagatgaagctgatggaaaatctgaatactttagaccttcaaaacaatgaccttttgcagattcccccagagcttgggaactgtgtgcagctacggacactactgctagatggaaatccattccgagttcctcgagcggccatattaatgaaaggcacagctgctgtgctggagtatttgagagatcgaatccctgcctgagtaccgctggtttcttactctgggcatggtcactcgggataggacagagccagcctccagtgtccaggtgtcactagacagtcactgtttgggctatggtcgttcctactaaatgtctacagtttgtgaagtgatgtgaacatttataatgtcaactgctacagattttaaatgttttataaattcattcctttatgacactgcaagaacttttcatatgatttttataatgaaaaagcaaccatctttgtaaatctgggttccccctggtatcttttcattttccatcttatatgaactgagcaagactatataaggtgtaaagtcagcgaacttttactaaatattattttttggcatttaaaagaaaatcggacttttcgttgtccaggataggacttgctatgtggtcagtgtcagtgcgtgtttatgtttagggttttggttttgactttacatttttttttttaatgttttcagtgtcctttattccaatgtgatacatcttattatttccacaacgttgattctgaaatctccttacagtctgattaaaactagactggtagttttacagtaattttctaaaaaggagttagatatagccaagcttgatttaataaaagtccaaatataaacattgttgtttacactgaaattatcagatgcagcttttcagccgtcctggttcatcatgtgattgagtcgagagtagccagctcagtagaagcatgtgtcagctcagtgtcagcctgcgtgcggagggtggaggtagagaacctataggcggttgaggttgttgatcttaggaaaatcagtgctaataaagatacatgcttcgtgttcataataaaagctacatttttaaggtattggtatagtgtttttgttttaaaaagaaacatatttttaccatgtcacagttcctaagttcagaatctgcttccatagtaaaccagacatcatgtaataaggtgacattttattatttatacaatagacttttatgttattcaaaacacttttttaaattctgaaaaaattgagtacaacagaacctaaaaatggctctgctatacaccacacagcgctattatctgtacaaagcgcatctgcagatgcttccaggctacaccctacccctaacccatagtgtcagaacgtaagacacagctggagagtacagatcacacttgcaaagtcattggcttggcagagttgaaatacaggttagtgggactttgcacataaaattgaacagctttctttcaaggttgttatggtctcatatggcaaaaaaccatgaagtacattcacaatctaacttagtaaagtagtaagtgtttcttcattcagttccatttacaccaatatgtagtttaactaaaaagtactgttactcatggtacattgtttgttttttttaacacatacaaaaatgacaatcttcatatataattttaagctgaaaatcacaattatctcacaatattaattacaatacagccagttcaattacacatgtcatggtttgattttctttaatataaaatggtaaactttattattaaagtaagcaatttgttttgaattggctagagtaacccaagtacaaaatctaaatgtgatgtgtgaggtgtttgctgcccctcccacccagtttgtatacagccacctaggctagcaaagagacagaaaaggccccaggttataaatattgagcctcgtttgctaaactgccttggcttcttggttcttccataaaagctctacaaagggcatgtccatagactgcagtgaaatgcatgcaatatatacagcgtgtagaattcagctcactgacacacatcagaatgtccacatagacagcaaaggatggacagaaggaacactcacctgccacctgtcatcagctagatgggagatttaggaatgaggtcccagttctggttctgagggaagattcctgcggttactgcagatctgttacccgggtactgcacttatggtaatgaagccagatcccatcagagagtatggtcaagagacccaaagctgcgtcaccacttaggaatttctcttacgactttttacgaggatgaaatgttaactggcaaatatgacctcaaaatttttatgtgcttgacacataaaacatttacagaataatgaaatacgttcatctcccacaaattactgagggcaagaaatcatcaatctgatagttttgaaagtgaaaaataaatttcatgagtgttt

SEQ ID NO: 508 - DNA, 2462 bp, Mus musculus
  modified_base (1127)..(1127): a, c, g, t, unknown or other
gaagttcggcggggaaagatggcggatgacaaggattctctgcccaagcttaaggacctgacatttctcaagaaccagctggagcgcctacagcagcgtgtggaaggtgaagtcaacagtggcgtaggccaggatggctccctcttgtcctccccattcttcaagggcttcctggcaggatacgtggtggccaaactgagggcatcagcagtattgggctttgcggtgggcacttgcactggcatctatgcagctcaggcatatgccgtacccaacgtggagaaggcactgaagaactactttaggtcactacggaaggggcctgactagaccctttggggaaagcaggacgagcatgttgggcctgcaggtagagccctttctatcacagacactctatctggcttcccctgctattattgttcatgtgctaactccgtctattctgcctctttcatccctgcctttcttcctgcagagagtggacagtgctttgtcagcctgcaccccagactccttccctccctagttccatgggactgaccccaaaactatgggccattaatcccctcttgaagacctaactggaatgtgcggctgtctctgatcctcagtattctctctggtgatgtaccacagttctatactcaatctcctacaaatgtgtcccagcccctctgtcccttgctagctacccaggccacctagggtctggtgtgggccatgagtgtagaagatgggggcgtgccaggcctagcccgcccaagacaggctcgctggaccctgttgctcttcctgtccactgccatgtatggtgcccatgcaccgttcttagcactgtgccatgtggatggccgagtgcccttccggccctcctcagctgtgttactcactgagctgaccaagctcctgttgtgcgccttctccctcctggtaggctggcaaacatggccccagggcacgccaccctggcgccaggctgtgccttttgcactgtcagccctgctctatggcgccaacaacaacctggtgatttatctgcagcgctacatggaccccagcacctatcaggtgctgagcaatctcaagattggaagcacagctctattgtactgcctctgccttgngcatcgtctctctgcgcgtcaaggcttggcgctgctgctgctgatggctgcaggagcctgctatgcatcaggtggctttcaggaacctgtgaacacctttcctgggcccgcgtcagcagctggagcccatcccatgcccttgcatatcactccattgggacttctgctcctcatcctatactgcctcatctccggcttgtcctccgtgtacacagagctgatcatgaagcgacagcggttgcctttggctcttcagaacctcttcctctacacttttggggtgatcctgaactttggactgtatgctggcagtggcccaggcccgggcttcctggagggcttctctggatgggcagtgcttgtggtgctgaaccaagcagtcaatgggctgctcatgtcggctgtcatgaagcatggcagcagcatcacacgcctcttcatcgtgtcctgctcgctcgtggtcaacgctgtgctgtcggcggtgctgctccagctgcagctcacggccatcttcttcctggccgcactgctcatcggtctggctgtgtgcttgtactatggtagcccctaagtccttgaccacctccactcacttgtgactgtgtagattaaatgcaaccaccagagttacctcccatccccctgtaatccccagcagccccgtaacaagtgccttgtaagagaagctaaggtgtccaggttagcctttgcgtgttcaggtgggagagttacccctaggaggcataaagagtgggcttggttaaggaaacgcctaactgcactcctgaattctttcatactcaagaggtgggatccccaaacccaggcctgtccttgaagatccctgccttgtcctgcatgtacatggctgcttcaagtgaagcttcagtcttcttacctgctgtggtcactcctgaagactctgtcccgaagtttggtgctggctgctccagcccagcatgacttccatataaagatgcttagtttgccccctccacagagctgttcccctcacccacctgttattctggaggggtcagaggaggccagggcttgactcatctcagggaacattggccctgggccctggcttaagcctacactcctgacccctgtgctaactcgagagccctgttgaagcctttccctctgaagcacttaggagctactgctctttccactctccgtggtgtcctcgcttccaacagctcgggagggctctgcagagtaaccagggaccaggtccagaaaatgtttatagccaatcagtgtctaactacttcagcaataaggtcttaataaagtgttctagggtgtggggtgcttcctacaacc

SEQ ID NO: 509 - DNA, 540 bp, Mus musculus
cggccgcgtgagtttcagaccccccaggatcctccctagcaaggccaagaccaagcctaggagcagggacagcaaccagtagatgaccagtgctgctgctccccacagtagaagggtctggacttggctagggctgagcttcaagccctgggtgagttgttcaccatccagccccagggcactcagcaactgggcagcaatcccagacagggcaaagcaggccacagagatggctgatgagatggcccacatcacctgcaacagggtctctgaaatcacatgcatggtctctggccctagccaggtatccaacatctccttcagagatcggccaatctgggtcaaaatatcagctgaggtctccttcttctgttgaccaggtgaggcaaactctcgatgagactgggctgatgcggagtggacgaggaaaagggccacgaggaccatcaggacagctttgagcagatgtctgctccataacggagtgctgtgtgcgcctgccatgtttgtgtcctgctccggtcaccttcgtgccgaatt

SEQ ID NO: 510 - DNA, 657 bp, Mus musculus
actattgccagaggacacctgcaattgaaatagtattaaactccatacatactctttgcctataccacacacctatgataaagcttagataaactacttttgcactttggggtcattattaagtgaaataaaggtcacggattctcctccatcaaccaggaggtatatgcccagataacagtggactcttgaaaggacagtaaataaacccgaaataaactgattttcttccatatacaaatacacttatgataaattttcatgtttcaatcaagggaagtaattttaaagctttgccaatctcattactttaatgctcatttaaatataagctcatttgaagtcactagtttttctcctaacaaagagacaaaatgggaggtacaacacagacagcatggatacattgggaaagggataatttatcaccctaatcagatcaacatataatttaaagctaatgagctattcctggaatctttccacttagcctcttttaacataaagtaatgaaattcacaaagtgaaatcagagatgaggactactgggctatatgtctgtggaattctctgcatctatttgtttgtttgatcagttggggcatgtggatagcagtgttttttccaatgctaaaaatcaaacccctgacttggaat

SEQ ID NO: 511 - DNA, 477 bp, Mus musculus
atgtttcattttgactgttgttcacaattgctaaggtttcctaaattcaggggtgacagtggaagggagaggtcaagcatgacttagtttgtgatctttagttgtgattttgataaatacctctgtgtgtggcatgaacacacaccacgtttctgattatttttatgctttttttgtttgtttgttattgggttagatcagacactcattaagaacttggctggtcctaattagaatgctaacagatatgtagcatgttacagaaagatattaaaatttaggtttgtcttaagttgctgacttatatttgcatttaaaaataagtcggtcttttataacctaaatgtctaggtatcaagttgaatatttatataataatgaaatagtagtattatgtataatggtttcttaaggaatgagttaaaatcatctcataataattttttatgttgaaaataaactttataaaatcttaag

SEQ ID NO: 512 - DNA, 637 bp, Mus musculus
gcaactaaaaaccctttggtttaatgactgccccccattccatttactcccctctcattgccttagtttcccagatcccttcagtagcccagggtactcactaaaactcgagcttctttgacctgtgtctgtcctcgcttgttggaaggcttttgcttctggctatacactgctagcattaacccagcccctgctaaataccattgaaattgacctctcagctcagtattgcccctgctggtcatttgctccatcccccagtggaactcttcaaccctgttgcccactcctaatgtgtgtgtgtgtgtgtgtgtgtgtgtgtgtgtgtgtgtgttttccgtgtgcacttgtactaatggaacttctactttggagcctttctgagggattttgtttttctgttgtgggtagttggttgagtgtggaggcatgtattagcttcatatgctatatagaatctcttatttttgaacaaatcttatgatcataccctctctggctttcatttatgtccgtcatgtttgctttttgtgatagtaaatgtatacttgggtatacacatgtataaaatacagatgtatatacatggaaaaataaactagatgggttaaagatgaacctatctttaacttctctg

SEQ ID NO: 513 - DNA, 533 bp, Mus musculus
  modified_base (388)..(389): a, c, g, t, unknown or other
  modified_base (467)..(467): a, c, g, t, unknown or other
  modified_base (520)..(520): a, c, g, t, unknown or other
gggctcagcaaacacagctttatttattcaccctgctgagacccgcattcgacctgggaaataaacagtgaaggactaagctcaccccgacagccagcacagctgattgctagcccactttgccagtcactaagtcacgctgtgccacccaagtgcaagcctttcctatgccccgtgacgcgtgaggtggctttgcaggaactcccagcttctaagcttctgccgagaatgacttcaaacaggcagcacgaaaagctgcccacacacggggccgtccttcccatgtctgtcctcatccctgcagactgccctcgtggcgagcgctgcttccagatgagatgaaggccttagctcttcgctctgcagctcctcagccccgtccagctcnnagccatggactcccgagagctcctgctttcatcttccgggtttcttttcttcttgggctttccttcaggttaaagctngggaatctcttcatttcttctctgtaatggattttaagcagtgaattaatttncgcctgggtaaag

SEQ ID NO: 514 - DNA, 548 bp, Mus musculus
ggtttttcgagacagggtttttctgtatagtcctggctgtcctggaactcactttgtagaccaggctggcctcgaactcagaaatcctcctgcttctgcctcccaagtgctgggattaaaggcatgtgccaccactgcccggctaaaagaatttttcaaaaggtttcttcatgaagtgcataaggaacctgcctgagtgcttatagtttcactctataaagcaatctaatttctctataaacctggtgtgagtttaacaagggacccacttcataaaagatgactaagtgttctgatttttttcaactgagagtctaaaatgggaaaggaaattatctttccctttaagtaccctgattagggacagcaaatagcactgtgacatgctatgcaagaaatcttctgtttgtaatcaatctatcaactataaactatagctaaaatctttgattacttaaaaaggaaaaaaaaatcaacaaacaaaaacctacaagcagcagctaaggctgatttccaggtaacttattgactcgaatgaagaaaattct

SEQ ID NO: 515 - DNA, 480 bp, Mus musculus
aaaactcttgaattaaaggtgtgggtgattatgaacagaagtcccaggcattcagactcctccccagccctccaaactcccaggggcttgttttctgtagcccttggatcataatattttccagacattcaggaattatatcaagaagacatttgaccactttgctccctgcgttgaaaaagaaaactcacttaagtaacacagcagccttatactacttttagtagttgtaaaagaagtttaaaaaaaaaaaaaagatgacacatagccagtcattcttaaagcttgcgagaaacttaggagtatgttgtgagtggccacacacgtttccctagagctgatgagatttaaaaaagaatggaggaattgattttggttaaaaataatattgggaaaagtgagccaagagtctatatccatagacaagaagaccaatccctgcaaccacagactgaagatgactctaagcaaagcgaatgt

SEQ ID NO: 516 - DNA, 2409 bp, Mus musculus
ggtcagtcctcctccaagatggcggcgctgttggcggtaaattcggctgccagcctgtggggaccctacaaagacatttggcagacagttggaagtgctctttggagaagacagcctgaagctgtccaccttcttgacatgattttgaagaaacacaaacccgacttcatttcactgttcaaaaacccacccaaaaatgttcaacagcatgagaaaattcagaaagccagttaagagggtgttgcgatccaggggcaacaaggaaccagacttcttcctgagcagctcattaaagaagcatttatcatcagtgacctttttgatattggggaattgtcagctgttgagcttctccttgctggagagcatcagcagccacatttccctggcctcaccaggggattggtagctgtccttatactgggatggaaagcggtgcattgcaaattctctcagaaccctgatacagtctagacgaggaaagacatggacattagaactcagtccagagctggtttccatgacaacacgctttacagatgagctgatggagcaaggattgacttacaaagtccttactttgctgtcacagattgatgtgaataatgagtttgagaaactacagagagagagaggtttgggcagtgagaaacaccgcaaagaggtttctgatctcatcaaggagtgcaggcagtctctggctgaaagtctttttgcctgggcttgccagtcaccattacccaaagatgacaccctcctacttattggacatttggaaagagtgacagttgaggccaatggctccctagatgcagtgaatctgtgcctccttatggctcttctgtactgttttgataccagctttatagaccaaagcacagaggaacgagatgatatgattcaccaccttccactgttgacagagagacagtacgtttcgacaattcactctcgcctccaggactctcagccttggaagcttcctggactgcaggccactgttaggcttgcctgggccctggcgttgagggggatatcccagctaccggatgtaacagccctggctgagttcacagaagcagatgaagcaattgcagagctggccattgctgataatgtcttcctgttcctcagcgaggctgttgtgctggctggaaacttctatcaggaagagttttacatccgcagaatccacagtcttatcacagacttccttgcatttatgccaatgaaagtgaaacagctgaagaatcgggcagatgaagatgctcgaatgattcacatgagtatacagatgggtaatgaaccccccatctcacttagaagggacctggaacacttaatgctcctgattggtgaactgtataaaaaaaatccatttcatctggagcttgcgctagaatactggtgtccctcagagcctctgcagactcccacagtcatgggctcttacctgggagtagctcatcagcggcctcctcagcgccaggttgtcttgtcaaagtttgttagacaaatgggtgacctgttgcctccaactatttatattccttatttgaaaatgctccagggcctggccaatgggcctcagtgtgcccactactgttttagcctgctcaaagtcaatggtagtagtcatgttgaaaacatacagggagcaggtggcagtcctgtttcctgggagcatttctttcattccttattgctctaccatgagcatctccggaaggacctgccaagtgcagacagtgtccagtaccgtcaccttccttcccgtggcatcacccagaaggagcaagatggactgattgcttttctccagctgacatctactatcattacttggagtgagaatgctcgcttggccctctgtgaacatccccagtggacgcctgttgtggtgattctggggctcctgcagtgcagtattcctccagttctcaaagctgagctactgaagacacttgcagcttttggaaagtctcctgaaattgccgcttcactttggcagtcgttggaatacacacagatactgcagacagtcagggttccaagccagaggcaggctattggtattgaggttgaactcaatgaaatagagtcccggtgtgaagagtaccccctgactagggccttttgccagttgatcagcaccctggtggagagctcattcccttctaatctgggtgctggcctgcgcccccctggctttgacccttacttgcagttcctgagagattctgtgtttctccgattccgtacaagagcttaccggagagccgctgaaaaggttatgttcagagtaaaccatttctctcctatgagtttactgtcatttctttcatccaaggagtaaggggctataaagtcactttggcttttggaagtcaataaaatccatagtccacg

SEQ ID NO: 517 - DNA, 3075 bp, Mus musculus
gaactaactccgatctcaggtgtttccagctctcggtagctttccagaaatcggactggcctcgttcccagtcccttgacttcagttccagaaagccggcgtcctgcagcacaatgccccacctggggccactgcgtcgcagggcctgggctgcgctgctcggccagctcctgcgacctcccagcactgtgtgcacccgcggctgtcatagccaggttgcaaaggcagtgttaacgtctgaacaactgaaatcccatcaagagaagccgaattttgtcatcaaggttccaaagggcaccagggatttaagtcctcaacagatggttgtgagggagaaaatcctcgataagattatcagctgtttcaaacgtcatggggcgaaggggttggatacaccagcgtttgagctaaaagaaatgctcaccgagaagtatgaagacaacttcggcctcatgtatgatttgaaggatcaaggtggagagttgttgtctctgcgctatgaccttactgtcccttttgctcgatatctggccatgaataaactgaagaaaatgaaacgataccaagttggaaaggtctggaggcgagagagcccagctatagcccagggccgctaccgggagttctgccagtgtgattttgacattgctggtgagtttgacccaatgatccctgatgcagagtgtttgaggatcatgtgtgaaatcctaagtggactgcagctgggggactttctcattaaggtaaatgaccgtcgggttgtagatgggatatttgctgtctgtggtgttcctgagagcaagctccgaaccatctgctcctcaatggacaaactagacaagatgtcttgggaaggcgtgaggcatgagatggtggcaaagaaaggtctagctcccgaggtggccgatcgaattggggacttcgtccaatatcatggggggatatccctggttgaggacttgttcaaggatcccagactatcccaaagccagctggccttgcagggcctaggggacctgaagctgctctttgaatacctgaggttatttggaattgctgataagatctcccttgatctgagtctggcccggggcctggactattatactggagtgatttatgaagcagtactgctagagtctccagctcaggctggaaaggaaactctgagtgtgggtagtgtggctgctggtgggcgctatgacaatctggtagcccagtttgatcccaagggccatcacgtgccttgtgtggggttgagcattggagtagagagaatcttctaccttgtggaacagaagatgaagatgtctggtgagaaggttcgcaccacagagacccaagtgtttgtggccacaccccagaagaactttctccaagaacgtttgaagataattgcagagctttgggatgccgggatcaaggcagagatgctttataaaaacaaccctaaactgttaacccagctgcactattgtgagaaagcagacattcctctgatggtcattattggtgagcaagagcggaatgaaggtgtcatcaagctccgttccgtggccagcagagaagaagtgaccattaatcgagaaagtctcgtggctgaaattcagaagcgactgtctgagtcttgattagtgcctgatttccatctgctgcctgtagaagaaaagttttcatttaggaccgagttctggtggactttgcaacagtggccagcatggatgttgtacaagtgccttctgcttccatctctcctggatacagaactacataaggtcctgaggactcgtggactagcactagcagctgctctgctagaacgcacatggctgtcatgcctgagaggcatcctctagctgcaaaggcagatctgaagtacctctgaattctctcaaagggatgtgaggatggtcgctatgagcaaggctctggaagagtcgcctgaggctaagactctgcaccattgaaatgagaagctaactatgtactttgttcctgactgtagcttgggaactaggttctggagagcttgtctccatcagactatggcttgtccatggagtgttgaatggaccgaaaaaaagagatggtgtcccaggggcccagcagagcatctgttggttcttccagttaacaggagaagggtggggctatttcataattttgaacattgaacttaatggatgataagttagcaatatggtcttttgaggtttttgaacaccattccctttgttaaagtaattctcctggattattccatatcctgatctggagattgttctagaagtggttatatgatatgttacatttcaaaaatgtactagtggactggagagatggctcaccgattaaaggtgcatattacttttgcagaggacctgagttcatttcctagcaaccacatcagggtgattacaactgcctgtaactccagtaactggtatctgaggctctcttctggcttccacaaacacctgcacttaatgtgcacatactgatgcacagacacatacacataattaagaatgaaataattttaaaaagtaagcatactttgagtaattcgttacccaaggattaatttgtgtagacattaggaaatgtttgaatatatactggagaactgtgtgagttacaagtaatctttcctggggctcacgtagtagaagaagagaaaagattttcttgtttgtcctctgtcctctacccacttaccatgacttgtgaagcacacatgtagtcttatatacaaaataaattgtaaaaagaaaaacaacccagtaaaacaccaacataaagtgtggctagggaagtggctctcttgatagaatgtctgcctagcacttgggaagtgaaagcaggaagatcggaagttcagagtcagctttggtgccaggcaaggtggcacaggactttaatcctagcacaagggaagtagagacaggccaattatctgtgagttatgggttggccatagctgcatagtgaaaccctgtataaaaatttattcagccttggattcacatgagatgctctctcaataaaacaaaacaaaacaaaaaaaaaaaaaaa

SEQ ID NO: 518 - DNA, 1092 bp, Mus musculus
gtccagaggtccgtctgtggtttgggggtatttgggtgcccctggaatgaagtacgttctgaagtatgctgcaccgaagtgaggggaccgggagtcatggagggccagagcgcagagatgctgcaggccaggtggaggcggagaagttgcagcgcctcccagtgcacaaagagctggagcaagaattcgaccttggcaccctaccggctccggaccgcactcccggacaggccgagctgccggccttggcgcgggacagcacgcagctgctcatcaccgtgctgctgccgaccgtgcgctgggggaggcggtggtagcgcgcttgccggtgccctccactcgcttgccccgcgggaagctgctatccgtgccgcggctgctcacccgctggcagcagttcgcgcgtcatcagagcatccacccaagaagaccactttcttgtgggacgaggtgagtggccagtgacggtgctgattggactgcaagctcgcccggaaccacagtatggaatggctgataaatgtgcctgggggcacccgaccccatggaagcagatttaggccaagaaggaacgcgtggccaagaacgagctaaaacgaccgcggatccgagtgcacaagatgtagatgcccaactcagtcggcctgcacccaacgagacacctgagtaaggaggagctggtctgcgcccagcaagtggccagtgactccaccgctgcagtgggacgcttccaggagcgcctctctaaggagaagacgcccctagagccccggaagaagaggaagttttagtccctctttgaggactttgtgaccgagaaaatgaccagttggagctactgaaagtcaagaacagcaagaagcctcatcaggatgtgagggggcgcatcaacaagcagatgagagaagaggaaaatgagccagaaaggcgaagagaaaggggatccagcaaagatctttgagtaagagcaggggctggagagatggcttagcagttaagagcactgacttcccttccagaggtcctgagttcaattcccagcaaccacatggtggctaaataataaataataaatctaaaaaaaaaaaaaaa

SEQ ID NO: 519 - DNA, 767 bp, Mus musculus
tcgcgcggcgcctttttttttttttttagatgcacctacggagaaacccaacaggggggaaacgacgagtcaaaacactaggcagttcctcttttcatgggctagaaacagaaagccacgaaataagggtcaaaggcctaccgtggtcactctaacagtacttaagacgtacaagcctcaagttcgtgactcctacttatgtggaaaacaccacaaaggggcacgtgggccatttctcactgggagtgcaagaaaaccttatacaagctattctagctatctaacaattgggatttggccatgcactgggaggttcaaacagtgcacagacaataaaatgggaagctacctatgtacttattggccaaagattaactccagcatactaactataacagctatggacttctggggggcaaccattaatctggtttggggttaccacacatagttctacattggccaaagtagtcctcagtattattattttatttacacaatggggggaactgaaagtccagtcagctactttaaaaagagagaaagagagaggaaaaataaaatactcaagtggtgaaattaagaatctccttggtactatgtcccacaggatactttaccagtgtcgcttcccatcagggaaccactcagggttgctgggggaactccaggattagcttcataacctatgccaccaacagcacctaggtgggggaaatttcggggctcctgaaccatagggatctcccatgttcatgtgttccacc

SEQ ID NO: 520 - DNA, 2165 bp, Mus musculus
gcccctcccttctgctggccgcgcggagtgggagccccaggtgcaacggagaagccgggttcacgggtccaggaactggtgaccctttcctaccccccatccccccaccacagtgctacccaccgcgttctccccgccgccgcgtggcaatgagcagcccggtcagcaagccgcctcccgagctcctcgagcctaacccagggaagtcctacggcattatggagattgccatcattgcagctgtgatcactgctgtggccttggtcctggtctgcctcctctttctcatgcttcgctacctgtacaggcacaagggtacctaccacaccaatgaggccaaaggcacagagtttgcagagagtgctgatgcagccctgcaaagtgaccctgccctccaggatgctggggacaccagcaagaaggaatactttatctgaggggtagcagacttgacatccctgcaagatgcttctggctgcaggagagaaagtacccccgctgtgtgccaccattatcagcaccaggaagcccccaagggcaccccaagactcttactgcagaacactgggtgcctgccaggaaaccgatacagatgggaggagtcaaggcccagagcactcttccagggactcagtggccacccagtggcattggcttcgcaaggaagagagaacatctggatacccaggtctccctgggcaatgcaggtatcatctcaccagcatggaagtcctcctcagtgtgcatgaggtggtctggacctgggagtgggacgtatagaagtgggacatctagaagctgcctggagatgatggcatcaagtgtcagtcattgacatttgggaagaccagcaaatgccagagctaaaaaagcttcttcatccatctcccatgcagctcaagacgattacaaataagtttgaaatgtgactgagcccgttctatatcaaacggcactactctaagtgtctgggaaatgtaaatgccacccattgctggcttttctctggtagaacactgtgtctgtgtgcagcctgcaaggattgtctagctctgtccaaagaagagggggaagggtgacctttcccctcgccagtcccagctacaggaaacaaatggaaagaggatacacagtaaccaggccactggctgaagcactgatttcttgataaacaattttaaaaagagagttgtgctcaacaaccatgagtgaactcggtcatgccagagtcccagtgcaaatgcctctgtgttagaagagactgaagatccccagacctgggtttggctcccggctcctctttattggtcttaggaccttcagccatgtgtttgacctctccagctttaacgttggcctttctcaagtggaaatgatgctgagttgccttacctctggctcctgactcccagcattgtgggcagggacagaagcatcagatgctagccattcgctgccttacagcgtcactaacacactggatgcgtggcttgcctgcctgtgttggccaatagaattcatctttgcaccacctctaaaagccccctgagaagtcactaatttagatttaataacagggaggaaatgaatgaattagccaaccccttgcaggtaagattgccagcggctctgcagtttctctaaggccagcattgctgtattgaaagaccgcccctcaggagccccctcagctgtgctatctccacctagcagccagcaaaaaaggagcctgagacactaatgaggatgcaagcttggtcaagtatggccaccagccaaaggagctatgattcctccgaatgttgtagggaagagaagcagtgattcagttataacaagggccagacgaccccagaatggaggatgtctgtgtcctcatctgtgaagtaaaaggctggccatagttgacacccattaatctagagagaccttatctgaaaccctagcggatgcttgaaacccaaggcagtattaaacccccttgtattcggcttttctgcacatacttatgttgagatttaatttataaattaggcacagtaagaaattaactgcagtaactaacagcacaatggtataactagaactataaagctgtaataaaagattcttgagaccatgaaaaaaaaaaaaaaaaaaaaaaaaaaaaaaaaaaaaaaaaaaaa

SEQ ID NO: 521 - DNA, 655 bp, Mus musculus
  modified_base (506)..(506): a, c, g, t, unknown or other
gtcttgttttttgtgggcctgtggggttcatgcccgcttaagaattcaaaatgcttttttaaaactccagggaatgtatactttataaggaagtttcacctactaccctgcatttaaaaattacaatagttagggattagcttttgccaccttcatttattttgttgtttcccctcagagccaatgaggtgccttcctctgatacaggctgtatctagatgtgggataaagaaggagtcaaaatatatcctgtgctgagcctgtctcctagtgttagattttatggtctgcagttagaggttacttagctcatggtgacagttaccttctgtagttgaagtgtgacaagctacagagtagaggcaaagtcaacttgaattagttgagccagaattacatagctgataattatacagtgaggttgctgactctctggcttcctacacagcagtgtttctgatacctagtgagggccatccttttcagctaagtaaaatcgctactgntatacctcactgaaatgtggaaaaggtagaaagtactggaaaaaatataaggccttgcattcaaattgacaaaggatgagaatgctatcttgaaatagatgtggctgctcagggaatgccaaagctggtccttgttttagtgatagggg

SEQ ID NO: 522 - DNA, 464 bp, Mus musculus
gcagtgttggggatcaaatcctgggccacacacacaataagcactctgcctttgagttgcacccttagtcatcaaaatactaatttttaatgaaagaagcttgggccttaaaattctgttttcacatttgcttgctttattagctcacatttcaacttcagtgttttaacaggtgggactgcgatcttgggtaaaatactccaagctaactgacctctatgcagcgctcccagtttaaggaggcactttcacctttcccgtcctaagttccaaagttccatgggaggcaggcacatgaatgaatcagacaactcctctatgacctccatgtctactttgggtcaagtgcttgctaacagtccaccccttcagcctgtgattcaccaacatttaccagagtgttttctgactaactaggtcatgtagacacagactctaatgaagtatcaacagacataaattac

SEQ ID NO: 523 - DNA, 1302 bp, Mus musculus
gaatcccaaggcatgccgggagttgtagtttctgagttgcgcccgtcaagcggtacggacgcctgagagcagagagttgaagtcgcacgtgcagctatggtctcggctcgtgcattgctctgggccatctgtgtgctgcgcgtggcactagccactgtgtacttccaggaggagtttctagacggagagcgctggaggaaccgctgggtgcagtccaccaatgactcccagtttgggcacttcagagtctcatcggggaagttctatgggcataaagagaaagacaaaggcctgcagactacccaaaacagccgattctatgccatctctgcgagcttcaagccattcagcaacaaagggaagaccctggtaatccagtacacggtgaagcatgagcagaagatggactgtggtggtggttacatcaaggtgtttccgtctgacctggaccagaagaagatgaacggaaaatctcagtactacatcatgtttggacctgatatttgtggatttgatatcaagaaagttcatgttatcttatatttcaagaatcaatatcatgaaaacaagaagccaatcagatgcaaggtggatggcttcacgcatctctacaccctgatcttaagaccagatctttcttacgaggtaaaagtcgatggccagtccattgagtctggcagcattgagtatgactggaacctgacatcgctgaggaaaacggaaaagacatcactggactctagggactgggatcaggtggaaggcagtaaagtccaggattgggaaaagcactttctggatgcgggtgccagcaagccgagtgactggaacagtgagctggatggggactggctgcagaagccaccatatgaggatggcctgaaagctgagggcatcgacaaggacgtgtggctccaccagaagatgagacctgctggctacctgacgcagtatgacctctcagagtttgagaacattggcgccattggtctagagctgtggcaggtgagatctggaaccatctttgataacttcctgatcacagatgatgaagaatatgcagagaagtttggcaaggccacctggggagaaactaagggtccagaaaaggagatggatgccatacaggccaaggaagaagtgaaaaaggcccgtgaagaagatgaggaggatctgctgatggggaagtttcacaggcacaaccatttgagcagattccacaggcagggcgaactatagtcatcctcactctgcatgctgagtggcccagctgcaactctaataatacacatttgaatgatc

SEQ ID NO: 524 - DNA, 1195 bp, Mus musculus
agcccgtgcgggacctgggctcgggccgcgtgttgatgatgctgccgccgggagagggtttcactttcagtgggatctgccgtgtgacttgcgtctaaggccagttggaagtatacggccatatcatcaaccaagggcagcctccccaagatgtcttttctgtctacacccactcttacctgaccatcaatggggttccgtacgcagaacccgagaaaagtgagaaggcgatcaggagggagatccgggccctgctcaagccttacacgaaactagatgacagaaactgggtggtgcggtacttccctcctctgggctccattatgattctggaacggatgcagtctcgttttgtggacttcctgaagacctataagtgctcctcatacgtgctcctgcaggagaacgctcctgttcgggtcaattctgagtttacaactttgaagaaaattggcatcagaagacagaagaggaagaaagccatttgcttgagtgagagtggcctttgtgccctggaagagttagtcagcgtgtcctgtggtgagttttgcctgttgtaaatgcctgtgtccccgaagcctcagtcactgctcaggactagagtcctgaggactggctcacaccagggctcactgtttgttttacctgcaaaagtagatagctgccctgtcatcctgttgtgtggcgcttgtgacattggaaagtcaacgttcaatagaatactgattaaccagttattaaataggtaagctcgcttgtgttttcattggtcatctgggcatgaagtgagattcaaatggagaaacttgcttttgtttgatcttctaaggtgtggcctcactctctagaccaatttggccttggtgattctcctgcctcagcctccccagtgctatgattataggcataagccaccatgcccagcttgatggacagactgaagttggggatttgtttaactcactgctgtcagctgggccatggcattttgcagggcagtcccctgcctcactcccatgctgatgctgatctgcagcagaggcacctgctctccgtccctgagccagccctgtgttagtttatagaataccgtgtgtgttgcaattggcacagggtcttgcctgcaccgtggccctcaccttgtggagtaggacagctacaaggccacacggggtgatgatccttgtgtgtcacg

SEQ ID NO: 525 - DNA, 196 bp, Mus musculus
tcatagagcttgcatgcgcactgttttaactcctcgttggatagtatttatggaaaggaggtgcagctgagagatgtaagttgttttgttgttgttggtggtggtggtggtggttaaacaatggttaaagaagacaaatttgtatgttctttaaattttatagaattggaagcattaatgttatgactttaaaact

SEQ ID NO: 526 - DNA, 1252 bp, Mus musculus
ctttgaaaaagctaaaaatgagatcctcgatgaggtcatcagtctgagccaggtcacgccaaagcactgggaggagatcctgcagcagtccctgtgggaacgagtgtcaacacatgtgattgagaacatctaccttccagctgcccagaccatgaattcgggaacatttaacaccacagtagacatcaagcttaaacagtggactgacaagcagcttcctaataaagcagtcgaggttgcctgggagactcttcaagaggaattttcccgcttcatgacagaacccaaaggaaaggaacatgatgacatattcgacaaacttaaggaggctgtgaaggaggagagtatcaagcggcacaagtggaacgactttgccgaggatagcttgagggttattcagcacaatgctttggaagaccggtccatatcagataagcaacagtgggatgcagccatttacttcatggaagaggcgcttcaaggtcgtctcaaggatactgaaaatgctattgaaaacatgattgggccagactggaaaaagaggtggatgtactggaagaatcggacccaagagcagtgtgttcacaacgaaaccaagaacgagttggagaagatgctgaaggttaatgatgagcacccagcttacctcgcaagtgatgagattaccacagtccggaagaacctggagtctcgaggagtggaagtcgatccaagcttgattaaggatacttggcatcaagtttatagaagacatttcttaaaaacagctctaaatcattgtaacctttgtcgcagaggtttttattactaccagaggcattttatagattctgagctggaatgcaatgacgtggtcctgttttggcgaatacagcgcatgctcgctatcactgccaatacattaaggcagcagcttacaaacactgaagttaggcgactagagaaaaacgttaaagaggtattagaagattttgcagaagacggtgagaagaaggttaaattgctcactggcaaacgagttcagctggcagaagatctcaagaaagttagagaaattcaagaaaagcttgatgctttcattgaagctcttcaccaggagaagtagactgtgtcaaaatcctgctcataatgtaatcacctctgcgttcatttgaagaatgaaaacttgagtcttttgtcctgcctcctttcctcccgctctacccttttccgtgcaaaataaagtcacagggtaaaagtcaaaaaaaaaaaa

SEQ ID NO: 527 - DNA, 311 bp, Mus musculus
gttaagtgcctgcattttgcttcacttgatcactcaccacaccatttgcttgaaagacagctactccctccaaaagcaatatgttcatatctgatgttctttgttaaggaatcatttctcgtttgaagacatagtgtgaacgcttcagaactgttttgggcttcttattccaactgcaggtttattttccccattggaaaccgactatattttagaaaaaatgattgttggaaggtgaaaattttttatcctttctcacaatttattttgtttgcatcttcgtacatgcttattaaatatttcatacacac

SEQ ID NO: 528 - DNA, 1197 bp, Mus musculus
  modified_base (2)..(2): a, c, g, t, unknown or other
gntccagctgagctatagttgatccaatctgcctccgggttgacctcagttgtgatcctgagctgtggagataagtggcgcttaaactgcgactgccgagtagggagacaattaagacaactcttgggcgaaacacggctatagtccattaaattgtctggagatacctgaaacaagagagtggagggcagccacatctctacagcctacatcaatgccaacgctggccacaggatcggcttacgacatgggtctatataagctaaatggctaatctgcctgcccaactgcagacacatgtggatagccaggaaaacctaacattcctaagggacgtgtttggtgaaaagagcctgcattcactggatcaagattcatgaaaaacttcactgctatgagaagcagaatccgttgcccattctccatggtgcagcagcgttggctgatgatctgactgaagagctacagaacaagctaccaaacagtgagatcagagagctgttgaaactgctgtcaaaacccaatgtcaaggctttgctgtcagtacatgatactgtggctcaaaagagttatgatcctgtattgcctcccgtgcctgacgatattgatgatgaggaagactctgtgaaaataatccgcctggtcaaaaatacgagcccctgggtgctaccattaaaaaagatgagcagaccggagcaatcactgtggcccgaatcatgcggggaggagctgcagatagaagtggtcttattcacgtgggtgatgagctgagggaagtgaatggaatcccagtggaagataagaggcctgaggaaataataaagattttgagtcagtccaagggagcaattacatttaagataatacccagcaccaaagaggagacaccttcgaaagaaggcaagatatttatcaaagccctctttgactacgatcctaaggaagacaaggcaatcccgtgtaaagaggcagggctgtctttcaggaagggggacattcttcagattatgagccaagatgatgtgacatggtggcaggctaagcatgaaggagatgccaaccccaggagcgggcctgattccctccaagcacttccaggaacggagactggctctgagacgaccagaaatagtagttcagcctctgaaactttccaacacgaaatcatctggttttagaagaagtttccgtcttagc

SEQ ID NO: 529 - DNA, 1344 bp, Mus musculus
gctctttgtctcggcctgagttcgtagggcacggcctagcgaggtcaacatgccggtcgccagaagctgggtttgtcgcaaaacctatgtgaccccacggagacccttcgagaagtcgcgtctcgaccaggagctaaagttgattggagagtatggactccggaacaaacgtgaggtttggagggtcaagtttaccctggccaagatccgtaaggcggcccgggagctgttgacgctagacgagaaggatccccggcgtctgtttgaaggcaatgctctcctgcggcggcttgttcgcattggggtgctggacgagggcaagatgaagctggattacatcctgggcctgaagattgaggatttcttggagaggcggctgcagacccaggtctttaagctgggcctggccaaatctattcaccatgcccgtgtgctcatccgccaacgtcacattagcctttggagctgacagatgtgagcttacccttgagggttcagaatcgtgccctgcaaacagcttatgggggactggggacagccttgtttccccatagcccagcgcaagggtcactgcggctcaagccgtacaccttgtgaaggtgtctgccaggcactcaagcagctggacaggtaacagctcttggtgccaccccccctggagggagattggagtcaatgttgaggtgacaaagctgtctgtggaggtacaatctaggccttcattgctatatttctacttgttaatttgccagttgagaatgcacctgtctgaagtgactggggtaaatgaaattgcatgctcgttaacccttctgtaaatgagcaccaatcatgacagctatacagagtgaagtctcagatttctttctcaccagctttcgtttatgggcagagatgtactcttgtctgaggtggtttgagaccacatggcattacaatgtggacaggaagcaaatcaaagcattagtatgggcactcttgttttccttccaagttactgagtctgaggtcaggagtgcctgtgagcctgcttgagtcaaagggcaggaccaaatggttcagcctcactttgtccccttattctgttcttcctgtccagggtccgcaagcaggtggtgaacatcccatccttcattgttcgcctggactctcagaagcacatcgacttctccctccgttctccttatggcggcggccgtccaggccgagtgaagaggaagaatgccaagaaaggccagggcggggctggagctggtgatgatgaggaagaggattaatttatacttggctgaactggaggattgtctagttttccagctgaaaaataaaaaagaattgatactt

SEQ ID NO: 530 - DNA, 1137 bp, Mus musculus
cccacacagcaagtgcactactggagtccctggacgcaagtaggcctccctctctcccatggcctccggcgctctaccgcgagggcagtgactttgacctccatactcttttaaatatagtagataagacagatcttgtgttgccaaaattctttggcccacatttaagtgggatgcagctagcctggaggtgtgaatgaatttcattcactgagaagtctaggggttagttaaccctgaaagatatccacacagcaaaaatgtttgcaaaactaaagaagaaaattgcagaagagactgctgttgctcagagaccaggcggcacaacaaggatcccacgctctgtgagcaaggagtctgtggcctccatgggagctgactctggagatgattttgcttccgatggtagcagctccagagaagatctctcatcccagcttttgagaagaaatgaacagatacggaagttagaggccagactttctgactatgctgaacaggtccgaaacttgcagaagataaaagagaagcttgaaattgcattagaaaaacaccaggattcttccatgcggaaatttcaagaacagaatgaaacattccaagccagcagagccaaaatggcagaaggactggctttggctttagccaggaaggaccaggaatggtcagaaaagatggaacagcttgaaaaggataaaaggtttctaacatctcagctgcaagaagtaaagaaccagagcttgagcctttttcaaaaaagagatgaaattgatgaattagaggggttccagcagcaggaaatcagcaaagtaaaacacatgcttttaaaaaaagaagaatgcttggggaagatggagcaagaattggatgcacgaaccagggaacttaaccgtactcaggaggagttggtgacttctaatcagttgtcatctgacttaaacgagcggctagaagaattgcagagacactgctcaacgctggaagagcagagagatcacttgacagcttcaaaagcaggtgcagaacataagattgtagtcctggaacaaaaggaacaagagctccaggcgatcatccagcagcattccattgacctacaaaaggtcactgctgaaacgcaagaaaaaaaaaaaaaaa

SEQ ID NO: 531 - DNA, 338 bp, Mus musculus
ctttcctccactttaatgagactatttccttctggtttgtattcaccacttgagattatcaattatagtaaaggtctcttatttttcagggtttctggtttgcacctttgttactttatttcacaaaattgatttcttccattggttttcgttttttctcttccttatccttaagatcggagttattaatcatttagaaataaaaatattaattctacagtaatttctctcttggttaaacattctaacaaccttttgattctttaaattttttgattaaaaaattagtgtgtgtgttgtgtgtgtgttaagtatgtattcctggtctcatgaagccc

SEQ ID NO: 532 - DNA, 656 bp, Mus musculus
  modified_base (199)..(199): a, c, g, t, unknown or other
atgtcatctgctattcagcttgtaatgccactaatcgaattatttctcattttagtcaagatgatctcactgcttttgtccagatggcagaaaacccatgtaacgatagagtggtttttggcaaaaacttagcattttcttttgacatgtatgatctggaccactttgatgaattaccaataaatggtgaatcccaganaactataagcttagactacaagaagttcctgaatgaacagttccaggaaccctacactcctgagctcaagcctgtggagaaaacaaatggctccctattgtggtgtgaagttgagaagtacttaaacgcaacgttaaaggaaatgactgaagcagcaagagttgaagatctttgctgtactctatatgacatgcttgcttctgctaaaagcggcgatgaacttcaggacgagctgtttgaattgctgggacctgaaggactggatctgattgagaagctgctccagaacagaattacaattgtagatcggttccttaattcctcgagcgatcataagtttcaagttctccaagatagttgtaaaaagattttaggagagaattcaaagcctaattatggatgtcaagtcactattcaatctgaacaagaaaaacagttaatgaaacaatatcgacgt

SEQ ID NO: 533 - DNA, 481 bp, Mus musculus
gttttaaagacttgttttcattttatatgtacgaatgtttggcctacatgtgtatatgtgcaccacaagtgtacagtgcctgtgagggccagaaaagggccttggattccttaaaactggaattacaggcagttgtaagccaccaggtggttgttggaaacccaacccagatcttctcagagcagcaagcgttcttaactgctgggtcacctctctagtattcccacatgttttcttttgagacaaggtcttactctgtgtactacgtatgcattgattctgcaggcaattctcctgcctttcaactcatagttacttctatcacatagatggaaaattaaggctctcaaaggttatccagtgatcgtagaaccatagtttttgagcaaggtctttccctcacttcattgctctaccatgaacaaggtcagtcttttaactcatggaataaacaaacaaaagccttggggctagatctatt

SEQ ID NO: 534 - DNA, 481 bp, Mus musculus; identical to SEQ ID NO: 533

SEQ ID NO: 535 - DNA, 683 bp, Mus musculus
atatttatatttgacatttattactttgttttagaaagactgtacacctcttttaataaaaatttgtaattataaataatagaaaaatatttcaaatttttgccattagctaaggggacatatctattatactgaagtcacacaagctatagacacttgagttatacagaagaaagctggtttcgaaaattgtgttccttaaaagaccatattgtaacttaccacagaacgtttgatactcaaatagagtatcacagtataaatagcttaatgttattgtgagaaagtctaaatacatcatatctctatttacaaatctcagctataatgatagaaagagaaataaaaataggaaggttggttagacaaacacaagctgcacaaagacacactgatgtcctaggcaggagctggcagtgcacagctacgtgtctcccacacccacgtgggtgcaggccacaccacactttccccttccatctaggagatgcacatatttccacaggtctcagttggctgtcttcaggggggccttacgaagggacctccggctggatcttgtgctgccgtgactcctggctggggactttacgttccactgtggagactgtggaggtcttttatcaagcagcgataaacataaaatgtcacttccttgttcttgggcttcgtgtttctctttg

SEQ ID NO: 536 - DNA, 325 bp, Mus musculus
gcctttaatttcttgtcctctacaacagtgtctcatccattcactttactcagacgccccattacttgtttttgtcagggatctttagagccgtcgcacactcattcccttccctgtctagggaaactttccaagctgcctttttccagtaacttccccaaatgacccaacacaaagggaaagaggtattatattctccagccccttttggaaacttggattttttcctttggccacatatatgcgtatctataagaaaggtgatgttgacatcaagggaatgggcactgttcaaaaggaatttcctataagtgttaccacaccc

SEQ ID NO: 537 - DNA, 658 bp, Mus musculus
cacccctggagacctcccatgtgtgcttcatccaaaggatggtctcccactggcctgcactggccttcagtaaatgttagcatggagagaaactggttgccgttaacccaccctcttcccagacctgcctcttagtccctgggaaggaacctggatgtgcaggctgtgaggtatggggtgggccgtccctggagtctctggggttcttgctcctcgttggacactgcatctgcagtcttcagaggttcatgaggtcagttgagatgttttttaatgttctatgttgaaaaccttcccaacagtgtttggattttcataactactgtggtacttctgtagctgttcacacccagtgctcttccttccaaacagagccttaatgtttctgtgaggatggcagccatggtgtctatccccaaagggctgcggacataaatgtgttcccggtggtctttgctgcccacatgtgactttcctataatctgatggtaatctgagtaaaatgtaaacatttattttattatataaatttataagatgttttatgtttaatgcctaatttctagaaagtgccagaaaatatatattaactatttggattttatgtacaacgatttatactctcattttacaaacgataccataaagcacataagct

SEQ ID NO: 538 - DNA, 1967 bp, Mus musculus
ggcggaggcgcgcagggcagcctgggtccagcccacacccctcaccaggaggcaccatgtggggatgttggctggggctgctcttgctgctgctggctggccaggctgccctggaggcccggcggagtcgttggcgcagggagctggcgccagggctgcacctgcggggcatccgggacgccggtggcagatactgccaagagcaggacatgtgctgtcgcggccgagctgacgagtgtgccctgccctacctgggagccacctgttactgtgacctcttctgcaaccgcaccgtctctgactgctgccccgacttctgggacttctgcctcgggattccaccccccttccctcccgtccaagggtgcatgcatgggggccggatctacccagtcttcggaacctactgggacaactgcaatcgatgcacctgccatgagggagggcattgggagtgcgaccaggagccgtgtctagtggacccagacatgattaaagccatcaaccgaggcaactatgggtggcaggctgggaaccacagtgccttctggggcatgaccctggatgagggcattcgctaccgcctgggcacaatccgcccatcctccactgtcatgaatatgaatgagatttatacggtgctgggccaaggggaagtgctacccactgcctttgaagcttcagagaagtggcccaacctgatccacgagccattggaccagggcaattgtgcaggttcctgggctttctccacagcagctgtcgcatctgatcgcgtctctatccattctttgggacacatgacacccatcctatcaccgcagaacctgctgtcctgtgatacccaccaccagcagggctgccgaggtgggcgtcttgatggcgcttggtggttcctgcggcgccgcggggtagtgtctgacaactgttacccattctccggccgtgagcagaacgaggccagccccactcctcgttgtatgatgcacagccgcgccatggggcggggcaagcgccaagccacttcccgctgccccaatggtcaggttgattccaacgacatctaccaggtcacgcctgcctaccgcctgggctctgatgagaaggagatcatgaaggagctaatggaaaacggccctgttcaagcactcatggaagtacacgaggacttcttcttgtaccagcgtggcatctacagccacacacctgtaagccaggggaggccggagcagtaccgcagacatgggactcactcagtcaagatcactgggtggggagaagagacgctgccagacggaaggaccatcaagtactggactgctgccaactcgtggggcccatggtggggtgagaggggccacttccggatcgtgcgtggcaccaacgagtgcgacatcgagaccttcgtgctgggcgtctggggtcgcgtgggaatggaggacatggggcaccactgagtctcagccactaggcgaggtgggatccacagccacagaagaggccttgggggccatgcccgatgaagccttgtgtgcactccgggaccaggtgctaatccctacagactcagatccgcgcgtgcgcgctaaggcagaatcccacctaggagacaaagatgcaccaggctggcggaagcccccagatatcacagccggaactgggaagggccctgtttggaaactgcagggagtatagacagattccaggtccctggtcagccaggccaagaccacgggagctaagacaccccaacctcatcaccctcctacccgccctctctctcatcttctttttgatgaattctgtccatctccctagcctccattttggttgtacctttccattctcagtactgctttcttattctttaaagatatttatttttcttttcattaaaataaaaccaaagtattgataaaaaaaaaaaaaaaaaaaaaaaaaaaaaaaaaaaaaaaaaaaaaaaaaaa

SEQ ID NO: 539 - DNA, 327 bp, Mus musculus
tttatgaacctccctttccttagaggggagtgaagaaaacaaaccatttccagcggaaagagacatgcacttcccgacgtttcaggacaacacacaggcgtcccatgcctgttttcccgaatccagtgctgtttacagattgccaagtcccttcatttcccaagatgggatcctgtgcccctgaccctaatagtcccaccatcctcgactgaaagaccacaagttggataatcagattcattagcaataaaatcctgggtgagcccacctctggtgatgtcatacaggtaacaagtcaccaatcatggcactgagcccagccccacc

SEQ ID NO: 540 - DNA, 965 bp, Mus musculus
cactcagggatcatcagaggtaatctgaggacccgcaatgaagcaaatggctgttccccagtctcatgctcctcctagttagtaactcgctcggctatctcagggtctttgacccctgtatttctgctgattactgttggctctggctcatcaattaatgccttaacaagataataatttctgcctgggtaccattaagctggtggttattggattctgatgtaaacaggtacccatcacagagtcagggatttgactcaggatacaactcaaggggagaatgtgagagatagttatacttaaaattttaattatggtgccttaagagacccactaaacaaaaatgcctctattgtagaccaccttcctgaaaggccggaggctgccatcaataggagataacaagccacatgttccacactccctaaacaactttgacacaccacactggatgtgcttgatcacatgtagtggggaggcacgtgggcaggaaatacatcacgacatatgtttggacctgatgggaaatgcggtggctttatgggttgcctttttaagcctaaatgtgatgacttattgccagtctctggaaacccgggagtggacctggccagagtctatcatcctgagcagtatgtaaataaagcttgcttcacattggtctcagaaccagaaaacggcgaaagagcgaagcggcgaaagaggggcgcgagaagtcgaaacgacacgagcaacgtcacggcacgatgagaggcaagagtaagagacaaccccggagcggggagcccgagacgacccagccgagagaggacggaaggaagtcccccaagacgggaggccgtaacaagcaggcggagagaataagtgactgggcagcgaccacagggcggtcagacgaagaacgcacgcagcgagtggagacagaagcacgaacgagaattcagagctgacaccacaggaggagg

SEQ ID NO: 541 - DNA, 597 bp, Mus musculus
acaacagaaaatacatttttattctatatataccaagaaaaagtcacatttttatctcaaattaaaaaggaccaggcaaacatctatatacatacataacatgcaaatataataagagagttgcataatagaaaagcaagctgtatttcttgctctgtcatttttttttgttaagtgaatctggccaagtcacctgacgttctgaccttcagcttctaaacctctaaaatgagagaactggatgctggacatgttgcattctagctttgatatgtttttcctccccacccccaatacaatggaagaaacagaaacacatgaaaataggaataaagaaatgaaaagatgaaggcatcaacatatagaaccttgcaaagatacatatattctatgcccccaaccaactagagatgataaatgaggaaatggctactacaaagcatcccataggcacaactggagcaaaccaactgacagagacaaagaagagacaaactgcagctccagaataaatgcagactgccttttctatgtcactgttcatttagatgttgtgacgacaagaaatctacataggtttctgtcaccctgagatga

SEQ ID NO: 542 - DNA, 983 bp, Mus musculus
  modified_base (153)..(153): a, c, g, t, unknown or other
tgctcctataaagaataatgaatgcacctctttttaggctcactcaagataccctttcttcttttgtgaccaagagtgccccagcttctcccacccatctcgagatcgtgtctgctcactccagtggccccaacacccccgagagcctgtcgnaggaggctcccccacccccataggagcctgagcctggcgcctcacagccacagtatgccgtcatacaggaggccaggtttccccagagtgcaccaggtgagagagaccccaggagaaggaagaggggcaaaggggctgggagtggggccagacagagatgcctgcatttggcactttgtgtaagtacctgagtgttgtgtggatggaaagttttggaaaacccggtggcacggggatttttttctttcctttttttaaatcggcatgcaggtgtggtagtgagtgactatagtattccccaagaggctaaggcaaggattgttgtgagtttaaggccagcctggcgtatatagtggacccctgtccctaaaaacaaaactaaaaagaatcggtatttcttaatggctttcttaaaaaaaaaaaaaaaaaaaaaaaaaaaaaaaagccatttcctcaccaaaagaagttagagaaactaggcactgattggaacaaagatgtatcccatttagtgagtagatgaatatttccagtttagttgcagatccacaatatagaataaaatgtgtatcttagtaaagctagaagatgggcattctggcggctaggctcaatggcccaaagagaccctgccctgccacctgtctccagctgctgatgtccacttgctgagaaccaggagggcagtggctctgactgcctgtggctgtttctgagttttgtgcctctgtcctaccagaatgaaagtgttggtttggattggggatttagctcagtggtagagtgctagcctagcaagcgcaaggccctgggttcggtcctcagctctg

SEQ ID NO: 543 - DNA, 669 bp, Mus musculus
  modified_base (89)..(89): a, c, g, t, unknown or other
aaggtaactgagctcaatccagtggcagacctcggtagtctaaccttagaatttgaaatatggcatagtcacaaactgattcagagaanctgaacagactaaggatcatgtgatctgactgatagactatcaatttgttagagtcacattagcattaagtcactttttttaaaaaaggactgacttatagtcatctcttcatttgggttgaacattcaacctctaacacttgaggctgttgttacatacataatgctgtctgtagcattcatagcaaaacagggtacctttattttctcccaacagcttttgaatttgaaaaagcaactttctttttagtaagcattagtgtatcgaattagaatattctcttgagggctggcgagatggctcagtgggtaagagcatcgactgctcttccaaaggtcctgagttcaagtcccagcagccacatggtggctcacaaccaccggtaatgagatctgacgccctcttctggtgcatctgaagacagctatagtgtacttgtgtataataataagtaaatcttttaaaatatatattctttcttgagttgaaaggtgagaattgaaaggactcgtgattgttaaaaaaaacatgaagcttgagtttcaggacagccaggggctatacagagaaaccgtctcg

SEQ ID NO: 544 - DNA, 1385 bp, Mus musculus
  modified_base (50)..(50): a, c, g, t, unknown or other
cttgggctgcagccccttgcgggccttcctgctgcaacgcgcgctggagnacgcacggcttggcgggaaggcgagggcactgtgcggagcctccggtgctggcggcggccacgagtggagcccgggtccggccgcagcacgcggaacagagcagaaggtggcggggtccggcgaagccacgatgaagccgagcagcgaggaagagggagagttggtgcagggcgtgggcccctgggacgagtgcttcgaggtggccgtgcagttggcgctgcgtgcgggacaaatcatcaggaaggccctgacagaggaaaaacgcgtctctacaaaaacatctgctgccgatcttgtgacagaaacagatcaccgagtagaagatttaattgtttctgagttgcgaaagcggtttccttcacacaggttcattgcagaagaggccacagcctccggggccaagtgtgtgctcacccacagcccgacctggatcatcgaccccatcgacggcacctgcaactttgtgcacaggttccccactgtggcagttagcatcggatttgctgttcaccaggagctggaatttggagtgattcaccactgcacagaggagcggctgtacaccggcaggaggggccaaggcgccttttgcaatggccagcggcttcaggtctccagggagacagatctcgcaaaggccttggttctgacagaaatcgggcccaaacgcgaccccgatactctgaaagtattcctgagcaacatggagcggctgctgcacgccaaggctcatggggtccgagtgattggcagctccaccttggccctctgttacctggcctcaggtgcagccgacgcctattatcagtttggccttcactgctgggacctggcagctgccacagtcatcattagagaagcaggcggcattgtgattgacacctcaggtggaccccttgacctcatgtcgtgcagagtcgtagctgctggcaccagagagatggcagtgctcatagctcaggccctacaaactattaactacggccgagacgatgagaagtgagccacacacagctcgaaggctaaaaacgcagcagcaacctgggaaagagctgtcccggtggcttaagttccaggacagtctaccatagctctccctgggccttgcctcggtgcttagctgattctctctaatctcgtgtagccccttttcaggtcggtacgtgttcttttcatcagagccaaacccagatcttgtgaggggtgtgttagtcatccatcctgattgtttttccagaatgcaaatctcaggtgatacagctttagaacgggctctcaggccctcccctgaccgtggtaagacggaatgcaataaatcagaattatagtggtct

SEQ ID NO: 545 - DNA, 559 bp, Mus musculus
atttcaacttctgtttctgcatggggagagtttggtatttcttcagttgaacagttctctggaacagttgctactaaggagcctacttcactcttttctgcttcaagttcagtggctgaagagatgatctgacatttttcaggttctggatctctggtctccatcaggttgtcagctttctccaaggacatgtcttgttcctctgagtcactgcttgtgcaagtgtcttgcattttgttttgagaaagagaatcctgtgatgtctcctcatctactcgttcattaacccattttaggaatttttctaccttactccgtactttactcttacacacgacaaaaggtttccctgagtcctcggtgaacaggatgtgcttgctcttcacaggcatctgcttgcgcagatccaggtactttgatttgtatttcacattcttctctagatacctgacctgtcgatggctgaaatttggaattccaccatatttttgtcctgagccatgcttgaatcctagaaggaaaccattgtcatcaacttctgaatctgggttttcatcaa

SEQ ID NO: 546 - DNA, 662 bp, Mus musculus
tctagtctaccactatatagcaaagttgagaatgttttctaaggtcttgttaatagagagctggccatgaaactaaggtttggcttatgcctccaggtctcttatttttctgcaaaataagaagtcactgatcattttcagatgtgtcattgtgcatgttccaaaattattgactcaattttttggtttatttttttttttactttgtttttaaagttaattaacctcaagtcaaaaggattgtactatggcctgttgtgagaagtgcccatgttgtgttatggtgaggtggtggcctgggtagcactcaggcaaaggatggggtccaggcccaaatgaattactatgaagctttgtgtctcagctcctgtttatatgacgtaggagaaaacactttagacatctgagtttctattacatttaagtttaataccctgagtcataagaaattttaagttttaaatacaaggtgggttttccaagtttgggttgggaaataaatattacttaaaacttataatttaagccgggcgtggtggtgcacgcctttaatcccagcactcgggaggcagaggcaggcagatttctgagttcgaggccagcctggtctacagagttagttccaggacacagccagggctatacagagaaaccctgtctcg

SEQ ID NO: 547 - DNA, 603 bp, Mus musculus
aatgtttaaagttttattgtataagccaaagtgcattcttatgtggaaaaaatgtatctgtgctgaaaatgccagagttggttagaaagcttgtgttataataagacaagctgccactctcaaagactccctcacacccactgtctttgaccccaacattcagattctcatttctgagttcagtcacaattctggaggcatcctaaccaatttccaccgtcttacaggtgaagcactggatatttaccagataattgaactcaccaaaggctccttggaaaaacgaagccagcctggaccctagctctgtccggaggttctgtatttgctcctgtggagctttattggagcggtgcaggttcctaaactcaggctttcagatgtgcttttttgcaaaaggcagccatttttctgtagcaggacctgcccaggaaagtcctcctaacggaaggcacaattcagtgcgttcagaaccaggacaccaacatcagtgcaggctgtgtgacaaggggtactgttgggcacaaatgaagcagatgccccaaaggtcacattaactcaggcatttcttcctcctcttcttggctggttctctgtcctgct

SEQ ID NO: 548 - DNA, 527 bp, Mus musculus
tttttttttttttttttgacataaatagacacaggaagctttacgtttatttgtagagtgactcctaatgtgcttaaaaagcagtcttcagagagcaaacatacacaaagctactttgaaaagccatttacacttaagtttctctaaaacagagaaattaactcttgcctcctgtagggttgatgccctcagcaagccttgatactcttgtaaagagcagccttataccgtgcaccagagacgacactgtgccaggcctcagtcgtctcccaggaagagtgcagcactgatttccaggccatcaccgtcttccagctccctcccgttgtcttcagtggtcgatgggccctgcgcttttccttggctccgcctattcttatgagtacaaagtgggttatttctctctttgatcttggaatgtgagtttgaaatggtttctcgtttgagagcatgttgtaggtagttataaaacctcccaattcttctcttgttttcctccattttctgatttgctatagtttaacagg

SEQ ID NO: 549 - DNA, 330 bp, Mus musculus
tccctcaaacagtaaatataacgtatcccaacaaaaccatacataacgcgatctgggaactggttccctgctagaaattcaacctactctgcacgaggccctggcttccctcttcagcaccacccaaaaccaactatgtccaagtgtatctttgctacttggactctttcctcactacccttctcttccctcttggaacttctcttaaattgaataaaagaattcataccctgttttggctctctcacgagaagccaagcccaagtctgaaatccactcttgaatttggtgcctgggggtgacttctgaataaaagggtcatatctgtgg

SEQ ID NO: 550 - DNA, 718 bp, Mus musculus
tttttttttttttttttcacaaatgtacatttttatttgcgcagtctaactagatttaaagggtggatgaatactactatagcagaggacaaataacttaggggaaatgttaaaacaacggcagaaggcaagttaccttttgaagcggtaagaaagggaaaccctgctcattatggcattgtaagtccttgtaagggtggatctatcagatagatatagcagggctgaagaatacaacagaacctgtccacagctttctttataaaataataaagaacaatgaattagaggtgaagttttcacaaacagaccaacatacagtaaaaaatttaagaaaaactatcagaagagaaagcaggtaaaacataaaaaccaggtaaaacagtttgaatgacataatttaaacagaaggaaccctggcttgtaatttcaggctgcatgatgctaaaagttttcattctagtatcttccagtccacaatcttaactctggccccttacctctcctcatttaaggcctccttttaaaagttcaattaaaattctacttgagacatgattactaaagaaaacaggcttggatgttctcaagagactgaactttatatactttaatattacaaacataaaatttacaaatgcacacataggcaaagtatttgtaagctgtagttctgaggaatgctctatagggtgcatacaacataagaattgggaaa

SEQ ID NO: 551 - DNA, 678 bp, Mus musculus
atgatgtccagaagaaactattctttcaagttccccataaagaatacctttaaaattaacggttcaagtccaagacttaatttaacactatctggccggtctcaaagaaaatgtacaaagcttgaaactgttgtaaaagaagtaaaaaaatatcaggcagtccacctacaggaatggatgattaaagtcatcaataataatactgctatatgtgtagaaggaaagctggtagatatgactgatgtttattggcatagcaatgtaattatagagcggattaaacacaatgaacttaggaccttatcaggcaacatttatatcttaaaaggattgatagactcggtctccatgaaagaagcaggatatccctgttatctcacaagaaaatttatgtttggatttccccacaactggaaggaacacattgataaatttctagaacaattaaggtaaactgtctaaatttttaaaaatcagcttttcaaggtataagttatggtccctaaaatgtactcattttagataaaaaaatatactgtgccttttcaaattcatgtttatgtaaccgatgtaatgtggttttgctgggtttttgtgtttgtgtgatagttttgaagatttttgtgattttaggggttttagaaataataaacctttattagactttctgtcatgttg

SEQ ID NO: 552 - DNA, 569 bp, Mus musculus
aagatttatttatttattatatataagtacactgtagctgtcttcagacaccccagaagacagagtcagatctcgatacagatggttgtgagccaccatgtggttgctgggatttgaactccggaccttcggaagagcagtcgggtgctcttacccactgagccatctcaccagccctgaagactaattcttatcaagcattctatttacaaaattacaaaaaagagtttcctagtaagtctgatttttagtgtataattctacaaaaaaagttataccctaaaatttttagtattatacagttattgttttgaaattataaactacaacattctcacctcctcctcctctaaaatgctggagtttgaccctaaggggtgtgtacatgctagggtcacattgacaacaattaacagtctattttaacattcttaatcagaagttattctctagctttgttgttttctcaaaaattctgtaaggtaaatgaagatgtctcttagtgtaacaagaaacactatcagctgcctcttttctgcatgaagtgtcctctagtcagccagtaagac

SEQ ID NO: 553 - DNA, 834 bp, Mus musculus
gacataaacattgattgaaagtaatcaaaccaaactctattatcagttcttctctcttaaaataggagagaatatggtttagttaggaaaacattctagactttgaggaataaatggttgacaaagcaaagcccttctcaaaagcactgaccaccagcacttgtctaggtcggacctacctctctcagtaacaggatgaaggaggcaaagtagaacacatacaccattcccaccaaccagtgcagaaacatcgtggtccctggagctgactgaaagctcagctctcgatctttcagagtagcatcaaacatttcctgagccaaaacagagcaggtcagagatccagaccacttacatttgcagtgcttaggacttccaccattaacaagtcacaaaacgaacattgtgtgatgttttaatttctaatgaaaagattttgtacatttataaattacaataaaaggtacaataaacactaatttggaaaaaccagtcagaactccaaatgtagatgatgtcaatgatttgggctttcagttctcttaatgctagttcacagtgtcaaaaaactatgtaagagcatgtaacactttaaaatgttgaagcatggacaggcaaggtggctgaccctaacttccatccttggactcttacaagctgtcctctcgccattgcatttgcaaacactcaaaataaatgatgcaaataaaatcatgaggcataaataattggttgcactagttctgcttgtttgtgtgttctccctgtgatgggatctcatgtatctcaggccagccgagacttgctgtgcagctcaagaaacatggaagttca

SEQ ID NO: 554 - DNA, 762 bp, Mus musculus
gctaagtgaatatagataaaaatctcaattgaattcaacactagaaagtatccagttatttcattaatctaagcctgcctaagtacttaaaatgatggtctgtgttttctttcatgcctctgaggatcaagaaattgtcctcactgtctaacaaagtacaaagcacagagcagagaataaatacgcaacttatgtaaacctaaaagaaattaaaccttaaataactttagaaatgtgttggtctggtattatttgtacttcatatataatataggaaaataaatacattaagctccacaccaattgaatattttaaaaattaaaagaacatctaagaacatttacagtatgcattttaatcttgacagcccagcatcattttaatacttactgcatctgaagttttgcttggattattgcttggattagaagaatgtgaatttgaactatgaagtgcactgtggttgtgtgagttttcttgtggagagtaactggtcccttaagtagaaataacaaagaataagcacagttacatatatttcatctatttttttaaggcatgccactgtaaaactggatgagtatcatatcctatgaacataaatgaaaacatgtaatccctacttagtccagactggctctggattcatacagcttcagcacaaggcagctgaaattacaagcgtatgatgttaacagcgaacacaattcatgcctctcatactacagaaaatgatagacatggcttaaaaataacactgc

SEQ ID NO: 555 - DNA, 1070 bp, Mus musculus
ccacgcgtccggtcagagagttttctggacaccacggccaaataaatgacatgacgttcagtcctgatggccgctggttgataagcgctgcgatggattgctctgttaggacttgggaccttccttctgggtgccttatcgactgctttttgttggactcagcgcctctaaatgttactatgtccccaactggagactttctagcaacttcccatgtggatcaccttggaatttatctatggtcgaatatttccctctattcagttgtctccctgcgaccacttcctccagattatgtcccttccatagtgatgcttcctggtacttgtcaaacccaaggtatggaagacttggaagaaaagactgagccaagtgatgaaatgatagagtatgagtcgccagaacagttgagtgagcaactggtgactctctcccttctccctgagtcacgctggaaaaaccttctgaatcttgatgttatcaagaaaaagaataaacccaaagagccgcccaaggttccccagtcagctccgtttttcatcccaacagttcctgggcttgtccccaggtttgctgtacccgaacccagcagtgacccccagcagtctaaggtggtaaaccttgggattttggctcaaaagtcaaatttctacctgaaacttgaagaaggattactaaataatcagtatgaagctgctcttaaccttctgaaagaattgggcccatctgggattgaaacagagctgcgaaacctgtcccctgatgacggtgggtcggtagaagtcatgcggagctttttaagcatgattggaatgatgttggacagaaagcgtgatttcgagttggcccaggcataccttgcattgtttttgaagttacacctcagaacgcttccttcggagccagcgcttttagaggagctggtgaagttgtcatcacaggtagaaaaagattggactcacttacagtccctcttcaatcaaagcatgtgtgtcttaaattacatcaaaagtgctttcttgtaaagaataaacttaagtgattacagaaatcaaaaaaaaaaaaaaaaa

SEQ ID NO: 556 - DNA, 1952 bp, Mus musculus
tggagagagggagccggtgtcctacgtcagagccgccgccgccgcggagccgccgccggggaggagcagccgctgccgcccaggactgggcccttagggaggaggaggcgagaagatggcggacgaccccagtgctgccgataggaacgtggagatctggaagatcaagaagctcattaagagcttggaggcggcccgcggcaatggcacgagcatgatatcgctgatcattcagcccaaagaccagatttcacgagtggcaaaaatgttagcagacgagtttggaactgcatctaacattaagtcacgagtaaaccgcctttcagtcctcggagccatcacatctgtacaacagagactcaaactttataacaaagtacctccaaatggtctggttgtttactgtggaacaattgtaacagaagaaggaaaggaaaagaaagttaacattgactttgaacctttcaaaccaattaatacatcattgtatttgtgcgacaataagtttcatacagaggctcttacagcgttactttcagatgacagcaagtttggttttattgtaatagacggaagtggtgctctttttggcacgctccaaggaaacaccagagaagtcctgcacaaattcactgtggatctcccaaagaaacacggcagaggaggtcaatcagccttgcgttttgcccgtttaagaatggaaaagagacataactatgttcggaaagtagccgagactgctgtgcagctgtttatttctggagacaaagtgaatgtggctggtttggttttagctggatcagctgactttaaaactgaactaagtcaatctgacatgtttgaccagaggttgcaatctaaagttttaaaattagttgatatatcctatggtggtgaaaatggattcaaccaagctattgaattatctactgaagttctctccaacgtgaagttcattcaagagaagaaattaataggacgatattttgatgaaattagccaggacacaggcaagtactgttttggagttgaagatacactaaaggctttggaaatgggagctgtagaaattctaatagtctatgaaaatctggatataatgagatacgttcttcattgccaaggcacagaagaggagaaaattctctatttaactccagaacaagagaaggataaatctcacttcacagacaaagagactggacaggaacacgaactgatagaaagcatgcctctcttggaatggtttgctaacaactataaaaaatttggagctacactagaaattgtcacagataagtcacaagaaggatcacagtttgtgaaaggatttggtggaattggaggtatcttgcggtaccgagtagatttccagggaatggagtaccaaggaggagatgatgaattttttgaccttgatgactactaggtagtcgacatgggtccggcaaccgtgcctcaccctccagcattcaacccaaggagcatacccgtggtggagtccaacagatccctgccttacaattggagcatttccagaacttaatccgtgagcattggatactgaaaagaaaagtgaaacaaaaccagacccaaccctacactttggtttgtcgtggtgtcagcgcagcagccgacaactaagtctctaaaggccactgtggactcatttaaaaagaatcccagtttttacttttacttgatggtaaaattggttgctcttgtattttatgaaaaaatgatttttttaaccttcatacatagaagcaaaatactttaactgctgtaaaccttcaaaagttagtagacgtggggtcatactggtttgtttcttcctttgatcggagaataactaaattgctgcatttcgcagtgacccatttacatggcattctcggcttagactgcacaagaagaaatatatgtgaaatattgaaaaaaaaaaaaaaaaa

SEQ ID NO: 557 - DNA, 541 bp, Mus musculus
  modified_base (470)..(470): a, c, g, t, unknown or other
  modified_base (511)..(511): a, c, g, t, unknown or other
  modified_base (513)..(513): a, c, g, t, unknown or other
ccacttaagttgcatgttttatttctcccaatcccagcaatagcacagaagcccatcatgtccatcccagactggtttctagtaggctgagatgacagggagcctcagtaacgctaatggcacagagggctcccaaatgccaggcacaactgtgcctccacactggtgactgcccagagtgccctggccccagtgtgttggcactcagtctgactttacaacgcaacctgcacctttgaaagggacagtctgggagtggggagtgtgagggagtgaagctcaaactgcctcctgtcagctcaccctttcaacattaaacagagaccaagagagaaacagttccaatatttcacatatattcttcttgtgcagtctaagccgagaagccagtaaatgggtcactgcgaaatgcagcaattagttattctccgatcaaagggagaaacaaaccagtatgacctcacgtctantaacttttgaagggttacagccgttaaaggatttggcctcnanggtatgaagggttaaaaaaaaccatttt

SEQ ID NO: 558 - DNA, 462 bp, Mus musculus
tttttcattgcactgcctttattaagagaaccaacagtcaacagtgaatgagtgactgacacctcagctaatttgtgaacttgaactacactattgcttttatactaaaggttatgtctggccttgaacttcaagtagattcaaatatccacacagtgggtggcatttaccatcatggagacactttcccttttcttcaaaattttttgtaagggaaaggaatacccaagagtgggctgaaaacagctgaaggcatggagaagatcctggaacagccagtgcctgagggggctcccaagtgctcagtcactaaagtgctagaagatatactctgtgggtaaccaaggccaacttttctcacagacgactctagtagagacgagtcagacaggaaaacctgctgatgtgcggcatcacagcctccacagaggtcccagcactcaaactccactgtgctgtctt

SEQ ID NO: 559 - DNA, 542 bp, Mus musculus
gttctagaagctcaaattcctctaactcatttttttcttttaatttcaatttcaagtcttcattttctcttctgtgctgttcatagtctaataccagatcattatattgagcattaagtgagttcaactcactttctacattttcctcgcttaggagcgttgttgccgagctccactctacctcagccaatgactcaagagtgttattcaacatttcaaactcggaagaggctgcactctctccgaacttcatgagagaattttctctcaaagaagtcacagaagttttacgttttcttgttgttatgcttgtcgggactttaaattccttttcatagtttgaatccttcattttgccatagcaccaagtaactcttcgtttccttttaatctctagctcctgctgcaatgcaatagaagatgacgtcaccagcatccgcttcaggttattaattttctcatcctgaactttctgaagcaagtctttttcatccagaagctgggccagttgatccttttccatttcctgtgcccgagtcttt

SEQ ID NO: 560 - DNA, 719 bp, Mus musculus
tttttgactctcccaccacgacagtggaaggcaccttaatgtattccaaacgaataaaacctgaatgtaccgaacatggttaggaacggggttaacttttgtagacaagtggaagtatcttatttaaatgtgttgtcctgaaccgtgtttctttatagtgcccacgaggtggcagcactgagcagcaagtccttgcaggaagatggaaccagtcaagacttctggctgttccaggccctgaagatttcttcggcagcatccagtgtgctgtcttttttaataaagcaaaaccgcaccagcttctcaaagtgtggtttagacttggagtcgcagaaggcagaaacaggaatggctgtcagtttcttatgtgtcgtcatccacttcacaaacttatagtcataaggctcatcgctgttcatgtccgagaggtcagcacctaatgaagacacatcagcaatgatgaagtaacccccgtcaggaacaatgggtttcaggccaacgctgttaagtaaacggaccatccgatctctctttacttctaattcctttggcagagaattaaagtaacactcagggtcatccatgcgcttgatatcgatccaaaacgcctgggccaatgctgcctgtaaaggagtcgcacacgtgtaaaaactgttctgttgaacggtctgataatgctttatcatgtgagcagggccaatgctccagccgagcttcca

SEQ ID NO: 561 - DNA, 4799 bp, Mus musculus
tggcctactgggctacctgcgtgtttcgcccttcagtggatcgtgtttctcgtctcccgtgtgcatcggcggttccttttccaaacccagtgcgccgtgagggctcggagccgcctcgaggcgtcgtagaaattgcttcatcatgagaaatctgaagttgcatcggaccctggagtttcgggacattcaggcaccagggaaacctcagtgtttctgtctgcgagctgagcagggcacggtgctgattggctcagaacgtggactgacggaagtagatcctgtgagaagagaagtgaagactgaaatttctttggtggcagaaggttttcttccagaggatggaagtggctgcattgtgggtattcaggacttgctggatcaggaatctgtgtgtgtggccaccgcctctggggacgtcatagtctgcaatctcagcacacagcagctggaatgtgttgggagtgtggccagtggtatctctgtcatgagctggagtcctgatcaagaactgctgcttcttgccacagctcaacagaccctgattatgatgacaaaagactttgaagtgatcgcagaggagcagatccaccaggatgattttggagaaggcaagtttgtcactgttggatggggcagtaagcagacccagttccacggctcagaaggcaggccaacagcctttccggtgcagttgcctgagaatgccttgccctgggacgaccgcagaccacacattacctggcgtggggatgggcagtattttgctgtgagtgttgtttgtcgacaaacagaggctcggaagatccgcgtatggaaccgagagtttgccttgcagtcaaccagtgagtctgtgccaggactggggcccgccctggcttggaaaccctcaggcagtttgattgcatctactcaagataaacccaaccagcaagatgttgtgttttttgagaaaaatggacttcttcatggacattttacacttcctttcttaaaagatgaagttaaggtaaatgacctgctgtggaatgcagattcctcggtgcttgctatatggctagaagacctcccaaaggaagacagttccactctgaaaagctatgtccagctctggaccgtggggaactatcactggtatctgaagcaaagcctgcccttcagcaccactgggaagaaccagatcgtgtctctgctgtgggacccggtgacgccgtgtcgactccatgttctctgtacgggctggcggtatctatgctgtgactggcactggaccactgatcggagctctgggaatagtgccaatgacttggcaaatgtggctgttattgatggaaacagggtgttggtgacagtctttcggcagacggtcgtcccacctcccatgtgtacctaccggctgctgatcccacatccagtgaatcaagtcatattctctgctcaccttgggaatgaccttgctgtcctcgacgccagtaaccagatttctgtctacaagtgtggtgataagccaaacatggattccacagtgaaactaggagccgtgggtggaaatggatttaaagttcctcttacaacacctcatttggaaaagagatactcgattcagttcgggaacaatgaagaagaagaagaagaagatttcgcactgcagttgagctttctcacctgggttgaagacgacactttcctggctataagctacagtcactccagctcacagtccatcattcaccatttgactgtgacccattctgaggtggatgaggagcaaggccagctggatgtcagttcgtctgtgacagtggatggagtcgtcattggtttatgctgctgttctaagaccaagtcattagcagtacagctggctgatggccaggtgctcaagatcctttgggagtcaccttctctggctgtggaaccctggaagaattctgaaggaattcctgttcgatttgttcatccatgcacacagatggaagttgccacgattggaggagaggaatgtgtccttggtctgactgacaggtgtcgcttttttatcttagtcactgaggtcgcatcaaatatcacgtcatttgctgtgtgtgatgactttctactggtaacaacccattcccacacctgccagggtttctccctaagtggtgcctcacttaaaatgctacaggcagctctgagtggcagtcatgaggccagtggagaaattctgcggaaagtggtttggggttcacggatcgtcacagttgttccccaggacacaaagcttatactacagatgccaaggggaaacctggaggttgttcatcatcgggccttggtcttggcacagattcggaagtggctggacaaacttatgtttaaagaagcatttgaatgcatgaggaaactgagaattaacctcaatctgattcatgaccataaccccaaggtctttctcgaaaatgtggaaaccttcgtatttcagattgattctgtaaatcatataaatttgtttttcacagaactcagggaagaagatgtcacaaagaccatgtaccctcccccgattaccaagagtgtccaggtgtccacacatcctgatgggaagaaacttgacctcatctgtgacgccatgagagcagccatggaggccatcaatcctcgaaagttctgcctgtcaatactcacatctcatgtgaagaaaaccaccccggagctggaaattgtgctgcagaaggtacaggaacttcaaggaaatcttccctttgatcctgagagtgtgagtgtagaggaggctttgaaatacctgctgctcctggtggatgttaatgagttatttaatcactcccttgggacctatgactttaatttagtcctcatggtagctgagaagtcacaaaaggatcctaaagaatatcttccatttctgaatacacttaagaaaatggaaactaattaccagaggttcaccatagacaagtacttgaaacgatatgaaaaggcccttggacacctcagcaagtgtggacctgagtatttcacagaatgcttaaatttgataaaagataaaaatttgtataaagaagctctcaagttatatcgtccagactcaccacagtaccaggcggtcagcatggcttatggcgagcacctgatgcaggagcacctgtacgagccagcagggctggtgtttgcccgctgtggggcccaggagaaggcacttgaagcatttttggcttgtggcagctggcagcaagccctctgtgtggctgcccagcttcagatgtccaaagacaaggtggctggccttgctagaactctggcaggaaagctggtggagcagaggaagcacagtgaggcagccacagtcctggaacagtacgcccaggattatgaagaggctgtgctcctgctgctagaaggatctgcctgggaagaagctctgaggctggtctacaagtatgacagagtggatattatagaaaccagcataaagccttccattttagaagcccaaaaaaattacatggactttctggactctgagacagccacattcattcgccataaaaaccgcttgcaggtggttcgagcgctcaggaggcaagcaccacaggtccatgtggatcacgaggtggcccatggcccagagtcagacctcttctcggaaaccagcagtattatgagtggcagtgagatgagtggcagatactcccacagtaactccaggatatctgcgaggtcatctaaaaaccgtcggaaggcagagcgcaagaagcatagcctcaaagaagggagtcctctggagggcctggctcttctggaggcgctgagtgaagtggtacaaagcgttgagaagctaaaagatgaggtgcgtgctattttgaaggtgctctttctctttgagtttgaagagcaagcaaaggaattacagagagcctttgagagtactctgcagctgatggagagggcagttccagagatctggactcctgccggccaacagagttcaaccacaccggtcctaggtcccagctccactgcgaatagcatcacagcctcttaccagcagcagaagacttgtgtccctgctctcgatgctggggtttatatgccaccgaagatggacccgagaagccagtggaagctgagcctgctggaatgactgccctgttaggaaggccttgccgggaagaccgtttgtccactcactcttcgtgcttctagctgtggagaactgggatgtggaagagtctgcctttgaacagcctcagctagcactaggcagtccccactttcttttgggtatacatcttaggtactatgtcagaacttcgttttagccagcttattgcagtctttttaaaaattgctgtttagctggctatagtaggacatgcctataatcccagcagcccaggaagctggggcagaaagactgatgcaagttcaagaccagcatggccttatctcaaaacaacccatcctgctgttcttgtactcagtactgtttgaaagcatggttaggcagatcatgaactggagtctcgtttctgttacaaccttggacagctcatcattgatttgatcctcagttcctgttgttcatagggaatgatgtttcatggtttctacctcaaaaagtgaagacaagtggaaccacgtttctaagttgctctgtgttgttaacatagtgcatggtattcatgtaggcagttagtgctgccagcttttagtaagatgtgattgcatagctggcatctgtgcattaactcaaagcagaataaaaagctgtttgggactggaaaaaaaaaaaaaaaaaa

SEQ ID NO: 562 - DNA, 505 bp, Mus musculus
ttcctgggaaccccaacggtttcattttattatcaaaatctgcttaactttgatgtaaacctccttaacttacaaatgtattattttcaaatattacacatatacatgtgtggtgtttgctccccaccggttttgggaggtctaactcatatcatgcacagaatgatatggaaactgcatacggagtagaggtttcagcatttgcccaacttttgacagtacacatccccacgagtgcctgggaagcagcatcactggctatcaaaccgaccgaggttcaaaggcatagcaccttccagcagagtggaccatcagatccagagccgatctgataggcaacactcccttcacaagtcctttcttcctagatctctccccaaatggagacgtaagggatcggaaaggcctactggtcattaaccgtgtccgttctggccagctcacaggtaatccctacagtcatgcaagttccaagtctttgcagcatccagttttacttgtctca

SEQ ID NO: 563 - DNA, 660 bp, Mus musculus
  modified_base (440)..(440): a, c, g, t, unknown or other
  modified_base (629)..(629): a, c, g, t, unknown or other
tttttttttttttttttaatattccccaaacatggattgttgttttgggaaaaagatcaagaggctactaaaatataccccttcctgaccacccttgtctgacctttgagcttatcacacacacgtgtgcaatttctcagacacagttaaggattttactttaaaaagttttatctatatcctctggaaaaaaaaagctcattttccttggttgttcttctgacgtagatgttttttcctcttgtagcaagtggtggacaacccagcagttggtttaaaagatctaccccaaatttcccagaagacatttcacaccaggccctgagatagccctgaacacgtgatttttcattgttttgttttgtggtttttgctttgaaagcagcaagcagacccaaccccattccataaaaagtcataaccaaaggcaatttcccctntagagcaagacaaactcagctaagccctatcctaactactgagctgtttttaaatcacccttcacccccggggtcaccccttctacactgtgagaagagcggagtattttgcaatgtcacctttcatacctgtggcacataaaatgcagagcaagttaacagtcacataacagttgtttttctttttanagttttgcattaaacacacgcacacaacaag

SEQ ID NO: 564 - DNA, 613 bp, Mus musculus
ccacagaatcaccaaagatcttcctaattgtgtctgtccgagagctgcagacatgaagtcaagatgggataagctgggtcagggaaggacccatgcattttgtgtatcaatggacaaatgtgtgagttttgacctgtatcatcttgctaatgatgtctgctgtttgaggggaagtgtaaaagtccaagaacactactataattttaactattggtggtatatttttgaacacaggttaactgtggaggttatctgctaatagcaactccgatactcttaaacactagttactgtgctcagccacaaagcaatgtttgcttggcgctagtgtgtgcctgtaatcccagctccgaaggctgaggcaggggtacacagtagaagccagcaaggttttgaaatgtgctgtaataggcacctaatttattggtcaggaatcctggtccaccaatcctaagtaccaatggctcctgctgtttactttgatattattctggattaaatggaattcttactatttaaatctctataatatttccgtatcagaagggactatttggttttttaattaaacttggctttttaatactgtatcattttataaccaatatttttg

SEQ ID NO: 565 - DNA, 507 bp, Mus musculus
aactgatgatcctgtaaaatccaaaactactgtaatctggtaccaaacgctgccctccatagcccctctgcaatcagtgcctggcttccccttatacctacctgtgctggcctctgtaccccatacagcaaacataaggaagactcactatgggacaaatgagttcactgctagtcaaaggctatgaaaacaagagggcagcaatgcgcttcctgcgctttatggggagtggttaaaacagaacgattttacttttcttttcttgtgactttccccgctttggtctttcgagacagggttcctctgtgcagtcctggctgtcctgaaccacaatatctgccatatcccatgagctttcccagtaaaggctactggagcctgagcacgcagacaccagtgtctgctccaggtaaaggtcagcaggaaaaatagtcagggaattcaaaatggacatgcaaactgagtacagtgtcgagctatagatcctgcttattataaactataggt

SEQ ID NO: 566 - DNA, 535 bp, Mus musculus
gagttcattctcaccaatagttaaaagtctttttagctcttcattcttttccttcaaaactctattgccttccacaacttctgaaacagactgttgcatttctcccattttgttttgctcttcggtgatgggtggactaacgagtataagccctttctttgctggtggctcaccaagctgaagtccatcttcatttaatcttttcctttctgaatgtgtctgggctctactgttctttggcatttcacttgtttcattacaagttgacttattgctggttaaagatgtatcaaccttacttgatgtcttgagcgcctgaaccaaagagttgctctctctgttttttagctcttcttgggctttaattaattcttctttagtttcagctaattctgctttaacttgattaaactttagctgcaaacaggcaatagcttcttcagtttcaagttctatgtcacaaattctatttgttggttcatcttgactgtcacattttccagccaaatctttgaagattgccaagcgacgttca

SEQ ID NO: 567 - DNA, 739 bp, Mus musculus
atagttgtaaaacccaacatctttcttttatgattttattacttacaaaataaaaacacattaggaaaaaaatatttccctttgcaagatatagaaactacaatctttggaaaatacataaacccccgtaattgttacaatacatagccttgtataccacttgaacattgtttaaaaatcataccctgtaaaggttggtataagaaacattgtctccaatgtcagccacatatcctgacatccatgtacttaagacacagttgaaatataatgtatttccaaaggggttatcttccactatcccagacactcttctattgtgtaagtttggtggtactccaggagtggaactcagtaagaggaggctgctatggagaccagctattgcagccctccctcccgtcatccctcaggatgccctctaagacccctccagagtactaagagtctgctgactctgtgttttctaggatgttggtagaacggcaccattggcagatctatgcggggtcaaatgcaactgaggtgattcagctaagtacatatgtaggatgtcaggtggctaaggtgatttaaaaccaccaaactcaaagttcctcttaggaactactggagaagatcctttcatagctaaatgtaagatccaggagaccagtcccttcctccagaagagctgtgaggagtgtgggagagagcaatagcccctcaagtctgcagctaatgataccagtagacagtg

SEQ ID NO: 568 - DNA, 597 bp, Mus musculus
  modified_base (306)..(307): a, c, g, t, unknown or other
  modified_base (344)..(344): a, c, g, t, unknown or other
  modified_base (467)..(467): a, c, g, t, unknown or other
attaggaatagtaatagtagatgagtaataaaaaaaaatgaaaagtggaaatgagagaaaagaataataattggtatgtagtttagggatatagggtggtagagtgaattaatagatttatgatttagaaaggaaagaatgaaaaggaaggaagagaagaagagagataaagaaatgaaaaaatgagtggggggaggggagtttgagtaagagtatgaggtagttatggttgattatggttgtggggtgaagaaaggggggaggaaagggggaaaaagatagtgggtttggggtgtttttgttttnnaaatataaagaggccttggttgacattgtgcccacgngattcgtgtgcatggaaggccttctcttgttgcacgggcagaggagtcaggtcatttaaatgtcattttctgatgtgcgttcatgtgaaccatgggtcggcatcttcttaagtgatctgtggnaccatttttaatgtttctatttcatacgtgccttgtgattgctgctgctgtgagggtacactcctgtcggggaaaagtctgttttggtttggtttttaatgaaataaacctccaagagcttacattcccg

SEQ ID NO: 569 - DNA, 2308 bp, Mus musculus
gaattcggcacgaggtggatagccagaggttagggtgtcttctcgaatcggggaacctctgattttggaggagccatggccctcagggtcactaggaacacgaaaattaacgcagaaaataaggccaaggtcagtatggcaggcgcaatgcgtgtgcctgtgacagttactgctgcttccaagcccgggctgagaccgagaactgctcttggagacattggtaataaagtcagcgaagagctacaggcaagagtgcctctgaaaagggaagcaaaaacgctaggtactggaaaaggtactgttaaagccctaccaaaacctgtagagaaggtgcctgtgtgtgaaccagaggtggaacttgctgagcctgagcctgaacctgaacttgaacatgttagagaagagaagctttctcctgaacctattttggttgataatccctctccaagcccgatggaaacatctggatgtgcgcctgcagaagagtatctgtgtcaggctttctctgatgtaatccttgcagtgagtgacgtagacgcagatgatggggctgacccaaacctctgtagtgaatatgtgaaagatatctatgcttatctccgacaactggaggaagagcagtcagttagaccaaaatacctacagggtcgtgaagtgactggaaacatgagagctatcctcattgactggctaatacaggttcagatgaaatttaggctgcttcaggagaccatgtacatgactgtgtccattattgatcggttcatgcagaacagttgtgtgcccaagaagatgctacagctggtcggtgtaacggccatgtttattgcaagcaaatatgaggagatgtaccctccagaaataggtgacttcgcctttgtgactaacaacacgtacactaagcaccagatcagacagatggagatgaagattctcagagttctgaacttcagcctgggtcgccctctgcctctgcacttcctccgtagagcatctaaagtcggagaggttgacgtcgagcagcacactttggccaaatacctcatggagctctccatgctggactgcgacatggtgcattttgctccttctcaaattgcagctggggctttctgcttagcgctgaaaattcttgacaacggtgaatggacaccaactctgcagcactacctatcctacagtgaagactccctgcttcctgttatgcagcacctggctaagaatgtagtcatggtgaactgtggcctcacaaagcacatgactgtcaagaacaagtatgcagcatctaagcatgctaagatcagcacgctggcacagctgaactgtacactagttcagaatttgtctaaggccgtgacaaaggcataactccaatagactgctacatctgcagatgcagttagccatgtgccgcctgtacataggatacctaccgtgtttacttgctcttcaataaaggttgtgacttctcattttacatagcttaactcatttgaatgttgttgcttctgagtttaggctaacggaagttgtcgaatttaggagtatattaaaaactgcatctagttttaacagtggatccaactaatgtatatatctgtagcctatatgtctatatacatccttcactgtgtgtccttatatcatcatgtcttctgcctcactctagtttaaactctaaatctaccagctagtcctttgttccattttccagtggttgccacctttaaccactgtctcttggttggtcaactttcagatctgaaaccaagtatctttttttatgtaattatttatttgttcttaattggaaaataggatgttcaaaattaaaggtgtgttttaaaaagaatttgcccccaagtctcactatcaacagataagggtgtatcttgtatatcctgtatagaaataatcatgcatatactcccaaggagatattttatatgggttcatttcatcaacagtattcctatcagcattccttacaatgcctatattgcatctcctagtgtgaacaaactgtgtgtaacatagtcattccctcgggggggattcaagtgcattctctcagtgccctccacagtgttcttaaatgatgtttaatgtcttgcttggctcattcatagtagtcttccagggggtgctttgaattctgacagccagatgggtgtggctgccaccataccaaggcgccactcctgtcttgtaatgccacctggaaaagaatcctgtctcatttgctgttttaatttatacatctgatatcaagttgaataaaatttattggtggaaagctttcacaatt

SEQ ID NO: 570 - DNA, 940 bp, Mus musculus
  modified_base (409)..(409): a, c, g, t, unknown or other
  modified_base (636)..(636): a, c, g, t, unknown or other
  modified_base (651)..(652): a, c, g, t, unknown or other
  modified_base (725)..(725): a, c, g, t, unknown or other
  modified_base (817)..(817): a, c, g, t, unknown or other
  modified_base (879)..(879): a, c, g, t, unknown or other
gctgctgtaaaaagtgtacatttcccccttccccttacaaaataatcggtggaaaagtatgaaaccccctgaagctccgcgaacacacacccagctgctcacacctttcaggctgtgacagtccatttgcagcacagttctgaaaccgctgcaaactcctcacgtcaatgcattttctgtccaatgttgccatctagagtagaaacgtgaaatcaggtgcatcggtagctacgaagcctttacaaactaaaccataacagctacttgctgacgaagcagccacttagccaaaggttttcccaaaaacctagctggaatggaaggagtcttcccaggggggtgtccatggtgcagtgctgtgacaacgtgcctgctaataggtactggctattggaatgtaaggacattntcactgctggtaatttccatactgtccctggtcgtacccataaggcctctgctggggtggctggggtggtcctggctgtgttggtctatagcccccatactgctgaccttgaccctgaggataattaggatactgaggacctggaccgccctgcgaaggaccatagctctgctgctgccctgggtatccctgctgtccgggtactgctgctgctggggtggtatccntgctgtgggagtgtnncctgttagcgtcttgctgttgccatacttgggagttccttcctcgtagtaatgttgtgaagaaatctcaatanggcctatcgtagcccttgtcaggatacgacggttggctgatacccgtaatcattatgaacccatcaggggtatatttgctgttcatggcttnctgggaggactttgtccaccattgactggatgggcccccataatagtcttcctgggcctgantacctggtgggtgggcccctgttgcgaagtctgtaggaaggcactgtcgctggcccatcat

SEQ ID NO: 571 - DNA, 581 bp, Mus musculus
atggaagcatgctaggatgctgttgactcattttctttaggagttcttgtaccttgtgttaggctggggcattcgatttcttgtaccttatttcatgctgggacattcggtggaacacatgtacactcatcagcatatgatgccttccttctatctgatactcttaggggcattactattctatttctatctctatctgtttatctacctatttggatacaattgggaagtttctttttattacaaggacaagtgtgttgatggtgaagttactgctgctcaactgagtaaagggcttgtatctaccatggaagtgctggctcacacatgcttgcaaagacttgatcacagaagagggtggacaggttgagtcccaggctggtaggaggtgagttatgtggaaacatagattgaattccaagatgctgtagttttagaaaaaactctggacaaggattaactttaaggaggccagctgaaactgttggtaggttcttcatctcacttatccaacatttgaagcaaggttcttaatgtaggtatgcatgcatacacatcaaaaaacaacccctgccaataat

SEQ ID NO: 572 - DNA, 658 bp, Mus musculus
tcattagcatgaaatctctcactggtatttgaacatgccccctcagaaaaggccatataagagcaggggtggagagaccaccaagatgtctaattctctgcaagagaagaaacttctctgttgctcttgacgacccttctctggcctgatacatgcctctgtaccagtcggaggctctgagaagctgctgtgtgtctgtgccttgagaaaaagatcatccccttccccatttttgccaatatatgtatggtgatacttaattattagccaactttatacagagtagtgaaaattcatatacctttgcataagcttctttaaactaaaaaaaatcaatgtaaaattaaatattgctctgtcttcttttcatcaactagtattaaaggtgttgttttttcccaagggtgaagacggttatgcttgacacgtgactactgcttctcttccctttgccttgacatagcaatgtgaataaaagctagatttttttccaaaagacttacttatttatgttaatgtttgccaaagtggcttagtaataatattaaaatatatctcttcagttttaaatgaaaattgaaaacatgccagattttaaattagtggtaacagagaagctgctttcttgttctaaatacagaaaataaatggcaaaagg

SEQ ID NO: 573 - DNA, 715 bp, Mus musculus
gtctatggcaggtaggcaactcggtcctatcacataccaagtagtgagtggagaaagtattttcagattcaagaaaactttggaaagtcaggaactaagctgcttggaaatcagtgccacaagcatgaccttggtggacacaggaagccacaggaaaattcttgacagtctgtgtcccatcagtcactgcatttttctttttccaaatacatcctgttggatactgaatagatcatagatattgtagactgagatctgggactgtgttgggaccattcaggtgatatgtcacttccacaaatggcatctccaagtaagctgtcacctggtacacatggaggtggagcctgcagctggagtgaggcgcacacttgactctacttgcaggtggtttgctgagcagagagctgagggaccctcttgactgggtaggggtcttgtccattgtgggggaggatgtggtgaaggtggaccttctacaatctgtcatgaactgtgatattgtaaggtctatattctgtatgtggataacagacccaatcaggaaacgagccttatgtgtgtcgttaacatttatattttcattcaaaatatgtattcagtgtttatttccttaaacagactttgttaatttaggaaatatctccaagtggaaacgtgctaactttctgtaaatcttaaataaaaggtgctgttccttcctctgacccaggaa

SEQ ID NO: 574 - DNA, 715 bp, Mus musculus; identical to SEQ ID NO: 573

SEQ ID NO: 575 - DNA, 509 bp, Mus musculus
  modified_base (208)..(208): a, c, g, t, unknown or other
gtgggtaaaagtaacactttctgaaggtagaggggtggccttcaagttttttcagtataaaatttgattttgttaaattatggagaacatttaaattgaactggttttctaacaggatataaaattctttattttaacttttttagagtcaggaagttgttaataaactgttaggatctagttgtctctgccctccagtgttgacatncctggctttcatgtgggggccaggggtttgaactctgctctttttacttttacagcaagtgttgttaccatatatacagatgaacagttgtgatttactgtgttggtgagtgaatagattcaaagagtgaatgaataactgaaagcgactggttcagtgtatgcaggtgtaaatgccatgtaggtgggaatctttttcaccttttttggatgcattaggttgttgggatattaccacacccagatgattacctatttcatccctgaagcaattatagtattgacatggctttacaatttaa

SEQ ID NO: 576 - DNA, 499 bp, Mus musculus
cttttatatgataatggtattgcctcttttacaaatctctgtgggccactgaggtaagcatttgttacttaagcatgatatctcttcacagcaatagaaaactccttaagattactttaattgtatataacttttcccactacttttcatagggaagaaatcgcctgtatatattaaaatatacatttaagtgtaaattttaaatatattttcactgacttggaaatctagagttcatttctatctttgtgactatttttgaatcataaatagtagcaaaattaaagttatacacatttacattaataactagttatctttcaaggaaataattagacgtggatgttctcttgtgatctagagttttacacatacaattttacaagttaacattctaattaaaattggtttgtttggttttttttttttccttttgcaaaggaatattactatccttgtatgatatattttttctcagtgttgtttctcattaaatacc

SEQ ID NO: 577 - DNA, 2784 bp, Mus musculus
gatcggttgcgtaaatacttttgaaagaccctattagcgcgcggggcgccacgtttgatctgtggacgggcttgggcgggtgcagtgccgggcagagagccacgcacgccatggagtctatgggtcggcaggaccgcaggctgcatcagcagcttaaggaaagcagtagccgcttccagacgttaatgaagcggctgatagcgaagtacaaccagccctttgaggacgacccgttggtggagatgaggacgttaacctacgagacgccccagggtacgaagccctcccttcctgttggcactgggccagaacagtgggcctagaatttgcaatgctgcatttgtcccccttgctcctagggaccttgaatccctgagttgctgatttccaatttaatttctctgaaagaaatgcctggagacacagtgcagcctggttttttaaaatgcctggcatggaagttcgagctaattgattagcggtacaagtgactctgtaaaataaggatgttgacaatcatgggtaagccgtatggttgtgtataacatcaccagagtacctgtcaggccattggaacagcacccaggactgctccgctctcatgggctttgctgtataaatgtagacccatctgttttggacagtccccattatctgccacctctgacgcattttatttaatgttgtgagtgtacttactaccttaaacctcatcggttctctaactgggataagtttgttatttgatgaggtcgtatccttccctaagacccatccctgatgtttgtctgaatttattgataaaatcggatttcggatcacagtctgccaggggtctacaagtgcagtctgtcttttgtcttattggctgttcagggcacgtgttgggtaagcattttaaataagcagaaactgaactaattctacaaagaggttgcttttctctggatgggatcaggacacagcaatataggaatccataagtgtgctgtctgactcttggcttttctgtgctcttgcggctgtttgtgaaggggtaggcagtgtctggagtattttggactgcccatctgtcttcaatgatatattctgtcagtgatatataactgatgtcagttatatgagaacagtgaagttgctgaagagtttgagactatacaagttggtataagagccctccctgaggtctggccaacacatagacacctagggctgcagttgtcggttaacaaatctatgtcctagcaagcttgccatgaatccctcatcttgttgattgttctgagagacacgtttttggcgcggcctttcctaacatgcagtagactgaagtccagatttaaggtggagactggagcagagagctaactgcagagaacaggagggaatcatttgtgtgtgttgacagttcacctgggcatgcacttagcacgtattgtagagttcagtttcaaacatgcaacattagcactttatgcgattaaatgtagaattccacggagagggccattcagcaaagccttgatttgacttagccgttgtagttgagcatcagtgtcctctggaaaggtcatgtcccacagtggtcagtgctatcagacctcccagaattcacatgctggttccacttcatgagcagagagctgggttagtcatctgaactttcctctttgcatatctgtctgtacagtggacatggtaagtctgtcctgtgggcttttaagagggtatgggagttacatgccacacgggttgcaaatacgaaacggtgtgtccttgctaaaacctggagcatagagggtgctgtgtaatttattttttctgtttctgttataataatataatctgaaatctccagacccaccatttttctaagtaacttgtgttttccttgagggatttagaaggactgagtgtacctcactggttctgctagctggggggtgacggggctgatgcgctccttcaagctccagagttctctgtacgtgggcttctctgtcctgggcttctagatcgccctaggaaagcactgactcccaagatgaggttaaatgtatgctacgtgtctccccctacctcccaaatatataacttaagaacagtatgtatttggaatatgagctgtgttagcccctcaggtacatggtggaattgggtgacctgctgccttctgggtaggagagactgccattagtgacaagtttgtccaatcttggttttttttaaaaactttctccttcaccaaactgactgacggcgctgccaatgcctggattgctctgaacgcttgcttgcctttcgcttccttcgctttggtttcccatcaaagcgttttaagcggaaatgcgagcatttcagattgcttcttcaattgtcacctttgtttcttaagggttgagagtttggggaggaaagctgatgaagaaggaagacaaggaatacactcaggtatttgccatcaggtttgccgccttcctgctttactctagtgtgttggtgggactgcatcccagcgccagagagcccggaggccggtgtgctctgtgatgggatgacctcctcctctgcccttacccctcctgtgtgaagataaactgagaagtgtttcttccacctcctggctcttgtctgctatttcttcatcatagtccacagcaagccatgtgtaccgatgctggaccagcttggggactctcagggaatgtcctagagggagctccttagttgggtccttaccaaaaacgcccaaatctcatttcctttaagaaaaaaaaaaaaaaa

SEQ ID NO: 578 - DNA, 952 bp, Mus musculus
aggaatgcacagggcaaagatggcggcggaggagcaggaggcgttgagggagttcatggcggtgaccggcactgaggaggaaagggctcgtttcgtcctggagacggctggctgggacctgcagaagctgactgcagaggtgaacaaccctggtgtgatgtcctcagtgagtgaagatattccattccagaggaggtctacttgatacatctgggaggctgccatccaaaagaaagccactctgttggtgtaggaagtgacagctacattctcctgtgcctactgcataaccaaaaatgaaggagaaatactgtttacaagctgccctggtatgcctgcttcattctgacattgacgccggtgatggaaacattaaatacattctctcaggagaaggagcgggaaccatttttgtgattgatgacaaatcagggaacattcatgccaccaagacattggacagagaggagagagcccagtacacactgatggctcaggcggtggacagggacaccaacaaaccactggggccaccttcagaattcattgataaggaccaggacattaatgacaaccctccagagtttctgcatgaaatctatcataccaatgtgcctgagaggtccaatgtgggtaggtaagtaatggtcacctattctctttctatctggtatgtctgcaggttgacaggctggtgcctgcccttcaacccaggaagcagagcttgtgttcaatcattattgcacattaataaggaaaaaatgctttgttagattcttaaaaattaaatagttttcttttcctcgcacaaaatatcatgattatggcttctgctctttccacccctcccagttactccacacatcccctgccatccagatgcaccctttcttttctgtctccatagtaaacaatcagactcctaaaagataatgagaaaagaatatataag

SEQ ID NO: 579 - DNA, 1064 bp, Mus musculus
gcgtgcgccggaagcgagccgctggcggtcgggctctgcgtgtccggaaaagcctaaagattaggttgtaagaaaaacagaagccatgtttcgaagacctgtgttacaggtatttcgtcagtttgtaagacatgagtctgaagtagccagcagtttggttcttgaacgatctctgaatcgtgttcagttacttggacgagtaggtcaggaccctgtcatgagacaggtggaaggaaaaaacccagtcacaatattttctctagcaacaaatgagatgtggcgatcaggggatagtgaagtataccaaatgggtgacgttagtcagaagacgacgtggcacagaatatcagtgtttcgaccaggcctcagagatgtggcatatcagtatgtgaaaaagggggctcgtatatttgtggaagggaaagtggactatggcgagtacatggataaaaacaatgtgaggcggcaagcaacaacaatcatagctggtaagaagctcgtggtgcacagtgtctctggttgttcattggaagggttggcgtagtataggccgcttttgctggcctctaagcaccctgatggcagctctgcaggaaactccccaggggacttcgtcctgttccttttcctgtgtgctaatgttgtccacatttatttattcctttaaaaggctctctgtctactcacatgtttagttcagggggactctgtggggtatgaaagcaacttgcccctgcagtacatactgttaacttggagaattgaatcttggtgtatactcgggcagttgcagaactgtgatggtaggaatttgtgatgtattcaaaactttgaaagtgaaggtgcaacagccttcatttgaaatttaaaaacttttgtctaaaaacaatatagctgtttatgtatctgtaacttaaatgcttttttttactcaaattatatgtagattaatgaaatatagatgccttaccaatttaatgccattttttaagagtacctgcttaacagattttaatatgttaatgtgaaaattaaaatgctattaaaattcatcttttaatgag

SEQ ID NO: 580 - DNA, 579 bp, Mus musculus
  modified_base (522)..(522): a, c, g, t, unknown or other
  modified_base (551)..(551): a, c, g, t, unknown or other
caattttttattatcaggagtgactgaaataaaaaatataattgagtcccatcattattgtcattatggaaatggctttaagagaaaactggtcagatgaatattattgcttcccacttttcaactggtaaatagttgccactgataaaacagacaagcccagagaatctgtccagaatgttcaagatatggtatattatacaacatgcctgttctcggggagaacacctaggacataattatgtgtatttcttgatctcatcatacaagacaagcacaaaggcgccacccatgcctctgagaacgttggaccatgcgccctgaaaaaagccttgctcccttcatcgcgcgcgatcttccgcagcagtcaaggcgtgccgtgtacatgatatcgttcctttgcgtccagactgcatcatcatacgacggcgaaccgtgtcaaaggataggaagtcggccagcgatagagtgacagactgtgcaatcatccagctgatgaagatgtgagtattctgggatctnggagcatttccttgcagtgttcctagatnccaaagtagggagttcgtagtgataaat

SEQ ID NO: 581 - DNA, 1609 bp, Mus musculus
cgctagggaaggaggagagagagggagagagagagagctgacgggggctgtgagtgagcgggaggagcggggtgtcagcccggccggcccgcgggagtgaaaggtagagcgaacgaggccccgagcccgccgcgcggccgccgcctccgcctcctcccctcccctcgcgcgcggcccgcccccgcccgcagcccgccctcctcgcggctcagcccgcagagcccgagcgaggcgccgttcggctcgcgcgccgtccagaacaggtgtgcgcgcgcctcccccctccctccctcctcctcctcgcgcccgcctgcgcgcgccggcctccctccagcctgcgccctccctcacctgcggcaggacagcgcccgccagcccgcccgtcccgatctcgcgagagtggctgactggctgtgggggttgcggcggcagcaggcggagccggggagggaaagcagcggcggctgaggcgactgaggcggcgggcggagcggcaggcggcggcggagcgcagcatcatggcggaccgagacagcggcagcgagcagggtggtgcggcgctgggctcgggcggctccctagggcacccgggctcgggctcaggctccggcgggggcggtggtggcggcgggggcggcggcggcagtggcggcggcggcggggccccgggggggctgcagcacgagacgcaggagctggcctccaagcgggtggacatccagaacaagcgtttctacctggacgtgaagcagaacgctaagggccgtttcctgaagatcgcagaggtgggcgctggcggcaacaagagccgcctcaccctctccatgtctgtggccgtggagttccgcgactacctgggcgacttcatcgagcactacgcgcagctgggccccagccagccacccgacctggcccaggcacaggacgagccacgccgggcgctcaagagcgagttcctggtgcgcgaaaaccgcaagtactacatggatctcaaggagaaccagcgcggccgcttcctgcgcatccgccagacagtcaaccgggggcccggcctgggctccacgcagggccagaccattgcgctgcccgcacagggtctcatcgagttccgtgacgctctggccaagctcatcgacgactatggagtggaggaggagccggccgagctgcccgagggcacctccttgactgtggacaacaagcgcttcttcttcgatgtgggttccaacaagtacggcgtgtttatgcgagtgagtgaggtgaagcccacctaccgcaactccatcaccgtgccctacaaggtgtgggccaagttcggacacaccttctgcaagtactccgaggagatgaagaagattcaagagaaacagagggagaagcgggccgcttgtgagcagctccaccagcagcaacagcagcagcaagaggagaccaccgctgccaccctgctactgcagggcgaggaagaaggggaagaagattgatcaaactgaatgaaacacacacacacacacacacacgcatacacatacgtgtacacacacacacacacagccacacacagagaaaatatactgtaaagagagaaaataaaaagttaaaggaattc

SEQ ID NO: 582 - DNA, 3456 bp, Mus musculus
atgatggcggcggcgctggggcccccagaagtgatcgctcagctggagaacgcggccaaagttctgatggcaccaccttccatggtcagtaatgagcagcgccagcatgcagagcacatattcctatcatttaggaagtccaaatcaccatttgcagtttgcaggcatattttggaaaccagtaaagtggactatgtcctttttcaagctgccacagctataatggaagcggttgtccgagagtgggttctcttggaaaagggcagcatcgagtcactgagaacattcctcctcacctatgtcttgcaaaggcctaacctccaaaagtatgttcgggaacagattctattagcagtagcagtgattgtaaaaagaggatcattagataagtcaattgactgcaaaagcatatttcatgaagtcagccagttgataagtagtggcaatcccactgtgcaaactctggcctgttctattctaactgctctattgagtgaattttcaagttcaagtaaaactagcaacattgggctgagtatggaattccacggtaactgcaagcgagtctttcaggaagaagaccttcggcagatcttcatgttaacagttggagttctgcaggagttcagcagacgggagaacctcagtgctcagatgtcctcagtgtttcagcggtacctcgccctcgccaaccaagtcctgagctggaattttctccctccaaatttgggcagacattatatagctatgtttgaatcctcacaaaatgtgctgttgaagccaacagagtcctggcgggaggctcttctggacagcagagttatggagctcttcttcactgtacatcgaaaaatcagagaagattcagatatggcacaggattccctgcagtgccttgcccagttagcgtctctccacggacccatcttccccgacgaaggatcccaggttgattatctagcacacttcattgagggcttgctcaacactattaatggaattgaaatagaagattctgaagccgtagggatctccagcattatcagcaatctgataactgtgttccctcggaatgttttaactgccatccccagtgagctcttctcctcctttgtgaactgcctcacacacctcacttgttcttttgggcgaagtgctgcgttggaagaagtgcttgataaggatgacatggtatacatggaagcatatgataaattgctggagtcctggctaactttggtccgagatgacaagcatttccataaaggctttttcacacagcatgcagttcaggtgttcaattcctatattcaatgtcaccttgctgctccagatggcacaagaaatttgacagccaatggtgtggcctcgcgtgaggaagaagaaataagtgagctccaagaggatgatcgtgatcagttttccgaccaactagccagcgtaggaatgctgggacggattgctgccgaacactgtatgcctcttctgacaagtttattagaagaaagggtaacaagactccatggccagttacaacggcatcagcaacaattccttgcttcacccggatcaagcaccattgacaacaaaatgcttgacgatctttacgaggatattcactggcttattctagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacagcagaacagattctgtgattaggctgttgtctgctgtgctaagagtctcagaagttgaatctcgagcaataagagcagatctcactcatctactaagccctcagatgggcaaagatattgtttggtttctaaaacgctgggccaagacttacctcctggtagatgaaaaactgtatgatcagataagtttgccattgagcacagcatttggagcggatacagagggttcccagtggattatcggctacctcttacaaaaggtcatcagcaatctgtcggtatggagcagtgaacaggacctcgcgaatgacactgttcagctccttgtcactttggtagaaagaagagaaagggcaaacttagtaattcagtgtgaaaactggtggaacctagcaaagcagtttgcaagccgaagcccacctcttaacttcctgtccagtccagtgcagaggacactgatgaaggctctggtcttaggaggctttgcacatatggacacagaaaccaagcagcagtattggactgaggttctgcagcctcttcagcagaggttcctgagagtgatcaaccaagagaactttcagcagatgtgtcagcaggaggaagtcaagcaggagatcactgccacattggaggccctgtgtggcattgctgaggccacccagatcgacaatgtagccatcctttttaattttttaatggacttccttaacaattgcattggtttaatggaagtttacaaaaatactccagaaactgtcaatctcattatagaagtttttgttgaagttgcacataaacaaatatgctatcttggagagtccaaagctatgcatttatacgaagcctgccttactttgttacaagtgtattctaagaataacttagggcggcaaaggatagacgtcacggcggaggaagagcagtaccaagacctgcttctcatcatggagcttctcactaaccttctctcaaaggagttcatcgactttagtgacacagatgaagtgtttagaggacatgagccaggacaagcagcaggcagatctgtatcggcagctgatgtcgttttatatggagtaaacctaattctgcccttaatgtcacaagatcttttgaagtttccaaccctttgtaatcaatattacaaactgatcacatttatttgtgagatttttcctgaaaagataccgcagcttcctgaggatctgtttaagagtctgatgtactccctagaactagggatgacatcaatgagttcagaagtatgccagctttgtctcgaggccttgacaccattagctgaacaatgtgctaaagcacaagaaacggattcaccactttttctagcaacacgacacttccttaagctggtttttgatatgctggtcttgcaaaagcacaacacggagatgaccactgcagcaggcgaagcattctacacattggtgtgtttgcaccaggctgaatattctgaactggttgagacattactgtcaagtcaacaagacccagtcatttaccagagattagcagatgccttcaacaagctcacagcgagcagcactcctcctgccctggaccggaagcagaagatggccttcctaaagagtttagaagaatttatggcaaatgttggtggtctcctttgtgtaaaataa

SEQ ID NO: 583 - DNA, 725 bp, Mus musculus
ggcctctgccgaggttggtgtgtcctgcggagctccgagcacggtgcggtggccagctgccagtttgaggcgatgtctgccctggtaagtacagttcggctagttccggtttgccccagctgtaggcagctacctaggtttccttgtacctaggcaagtgttacactgctgggagaacagcagccaatagctggttggcattctgggcctggttcatgccacctctgttgttaactataccaggatgtcagcatagttgcttacccaggaagagaagcgcaagctctgcaggaagaaacctgaagtccagatcttccgacatggaggttacttaaatcacaacttggaaatggaactgagtaaaagccactgagggaaataaataggaaaaaaaaaagtcaagatttagtgcctgtaaatggttgggagcggacctgaggcagtggagggagttactagactgcacgttcactaaaaataggatgtttcctcgctccacaataataaaagctaagtcatgatcccctttagtgagctccctgttgggaatatgagtctgggtgttgtagtatgcagggccccttcagaccgtccaggcaacctagatgcccaatctctattactattctgctctctagctcgtcaataaatttatgcatattaattgaccatggggttctgggaactagcttaggtcaaacagtacaatgagcagttaggctccc

SEQ ID NO: 584 - DNA, 1145 bp, Mus musculus
gaaagatggagccgagggagagagggcgccacgaggtgctgaggtgcggggttgtccagatatgacggggccgccgcctacctggatcttccactaagcttcaccttgtccccctggtgagaacaagaggtgtctgtccacgtagcatcgacccaccaccagcagtccatttccaatggaagtcctggatgagttcgacaacgaattccccctgagtgtgaccttctgccagctcatttccgaggatgacttcgagaggcaagcagcgacctacacagagcgtgcactgcgacgactcttccgcaccttggatcgcaacccagcactggcggagagagtcgtgcggaagggcaagcagactgagttcgagcagcgcgggctcctctgcagcctctgggcgaagtttgtctgcgctgtgcagggggatctaaaccagtgcaatgacatgggtgccatagagatgcatcggcgcctggagcagctgaagaggcgcatacatcgtgtgcatctgtattcccaggatgccaagaagaggaggaggaggccaaaaccaaagaaaccagatcctatctttcgagatcagtcaacctccgcatgcctgccaccagctctcttaccaccaccgctgctgccgccaccaccacaacctgtcaccaccgtggcctctgtagtggctgcatcaccctctgtctacactatgccccgggtctttggcactttccctccactgtctggcaagccgatggagaaactggatatttcaagttctgaagtgaaactaaactggagtggtcttcatcaacggcaaagagccacatgctccacctgacccccttggttctcaatcccggaggcttccatttctcatatttggcaggaagcagtgcacacaagctccattgtcctgcctccccctggacgccagcctgtagccgaccctccaacacgcatgacacgccatctcctgttgtgaaaacctccatcttcactccccctgtactgctcaagtcccaacctgtgcccacacccaatcaccacccacacaaccacccccccaccccacaccccacccccgccaaccccacccactaatctccccccaacacaccacgccccaggactgaataaaccccaccctcctcctg

SEQ ID NO: 585 - DNA, 653 bp, Mus musculus
atcaaaaaagatgttttttcagctgcgaaaaaaggatttttttttcccttttagaaattacttttaagataagaattgcaagcatttgattgtatttttaaaggaacactatctttttaattgcaaaagaaggcagaaagtgggtttatggttcatatctaggaacttaaaactgtgccaagccatacattccaagttagaaatacgtggaaataattttctttgatgtttcattcataagccataatcattgtctttttttttcctgtattttaaatttttcttgtgtacatttttcataaagtaggatgagttgtctgtttatgcttcatttttacatgtagtttcattttatatttgtgaacagtgtttactcatgaagagtggggacagagcactgtgaatcttttgaatgtggcaggttatcaattctgtaaacacctttgctccatatatgagttaaagtagacttaacaaatcctttataagtgtacttataagtaaatattttacaaaaatttactaaaaatccagttggaaaattgttaatatttaaattgtaattggctttatcatgtatgtaattctgtggctagcagtttctttaatcatcacatacataacacatatacatacaaacacgatcccttttg

SEQ ID NO: 586 - DNA, 686 bp, Mus musculus
  modified_base (50)..(50): a, c, g, t, unknown or other
  modified_base (57)..(57): a, c, g, t, unknown or other
ttgataaagtattgatttttcaaggggaatttgtggttgtgtatttatantaaagcnaccaaagagatgatagtgaaattggatacattttcagtaactcagtgtgtccatcaaggggcctctaagccagttcatatgtagccttaattagcagttctttttacaggtcttcataaaattaatccagtaaaccaagtatgcattgttagctttacatactttgaatttatactccagtcaagaggaatcacctaaatatatcattttgagttcatgtcactcagacattaactacagtttcctattatgcagttttttgcaatcggtgatgtatcattccctaaatcccatgttttgtttgtacattaatcagaattgggttgtaatattgttatgtgcctttatccaagcaaaattttacaaaagcctttatagcaggggaaagataaaaaagaaagaacatgtttttctggattactgtacttttgctataccaaacggtatttattgtgaagtagatgtaagagggtgggggtgggcttaaatgcatatattccgagtgcaaacctatctgcaaattttattatcattataaggtctgttgacctctttagaagttttaaaatatgagtccttttgaacttccttgtaaattttaaatggaataaatggactaagaagtcttc

SEQ ID NO: 587 - DNA, 691 bp, Mus musculus
cagactcaagctgggtagacattcaataaattgtctctcaaataaaatagtgtaagtgtggtgtgggcattcagtttgtttcttttaggacccctaaaacaggtgctttaaggggaaatgggaaaaacagggcagggaaacttttaattaatagtggggggcaatatagagtaagacggaggaaagaggaattaaaaaaaagctaccaaggataattgaacaaggcacagggaaacattgtttctttaaaatacatacataaatgtacgtgtatacgtacatatagtttaagtagagtttttctatgtggggtgataaggctgtgttgggccagggtgattatcttaagattagtagtcatcttattacaaggtcaaaataaattaattcctattttctgtaaaacttgggtttgaccaggactcccttcattttatgatattttccatgctctacactctataccctgaccactactctgataaaatgttctgtaaaatgattttgaaatgttcaagtttctacataactagaattcctctggaaatcctccaacccttgaaactcctccggccttgcagttttggggctaatataaacctcatcttttgtgttcaacactatttttctcaaacctcactctagggaaattgccctgtctggcagaaaataaagcttgagtaatttgtcc

SEQ ID NO: 588 - DNA, 323 bp, Mus musculus
cagtccaaggcccacgtaggggaacggcacctccagggacagattcccctcctgctgaagggttcgaccccaccatagtgactaagacggtgccagtgaagacactacagaccctggacagaaggattcttcttccatgtcgctaatcccgtgattatttctgcaaacatgggcagagccaggcaggctgtaaataaatccctttcgtcctagcactaaggaggcaaaggcaggaggatctttgagtttgagcccagcctggtctacatgtgaccttgtctcaaaaacaaaacaaacaaaataaaacaaaacccattaaacct

SEQ ID NO: 589 - DNA, 699 bp, Mus musculus
ttttcattttggtaaggtttagttgagcctaattatttttttaagtagaatatgccaacgaattgaatcaaattttagcattaatgcagagcaaatattgccacttaaaaaaaatccctgtagccgagttattactaatataaatcatccaaactgtaaattttgtagcttaccatttttaaatattgggtatcattaaaatgaaattttataaagcaatggttagttttatgaattactgtttttgtcctgtctctactttttttggtgtctacttttttcaagtagcctttagctcttattatatttttgagttagcatattagggaatggatttcatggtgatattttcatatgcatatatcatcatacttggttcttatttactccccacaaccttggctaccatccaattcctgttggtgccttccttctaaattctctcttttgcactcttgatacaaatgtttattacatcttgtatttgattacctcccttatactttgtatacatcctgtttacattttttcttcccctctctacttttatgttttgcatatatattgtgtattataaatatttgattgaaaaatgtgatatttgtctggcttattttgcttaacacactgatcttcagttccaaaaaacattataaattaattcttctttacacatcaataaaattccagtttatacgt

SEQ ID NO: 590 - DNA, 4704 bp, Mus musculus
tgactgtggtgtctgtgcgtcccgcaggaggggagtccgcgctgccgcgcccgggcggcgggcgatgatcacctaggaggctggcgcgagcggcagaggagccgggcgcggcgacacgcggccatggagcgggagctcccggcggccgaagagtccgcatcctcgggatggcggcggccgcgaagaaggcgctgggagggcaggacgcgcacggtgcgctccaacctgctaccgcctctgggcaccgaggactccacgatcggagcccccaagggcgagcggctgctgatgcgcggctgcatccagcacctggccgacaaccgcctcaagaccaccaagtacacgctgctgtccttcttgcccaagaatctcttcgagcagttccaccgcctagccaatgtgtacttcgtcttcatcgcgctgctcaactttgtgccggctgtgaacgccttccagccgggcctggcactggcgcctgtgctcttcattctggcggtcacagccatcaaagacctgtgggaggactacagccgacaccgctcggaccatgaaatcaaccacctgggctgccttgtcttcagcagggaagaaaagaagtatgtgaatcgatactggaaagaaatccgagtgggcgactttgtccgtctttgctgcaatgaaatcatacctgcggacattttgctgctgtcatccagtgaccctgacgggttgtgccacatcgagactgctaacctggatggagagaccaacctgaagcggcgccaagtggtccgtggcttctcggagcttgtttctgaattcaaccctctgacgttcaccagtgtaatcgagtgtgaaaagccaaacaatgacctgagtaggtttcgtggctacatcatgcacagcaatggggaaaaggctgggctgcataaggaaaacttgctgcttcgtgggtgcaccatcagaaacacagaggctgtggctggaattgtcatctacgcaggacatgaaaccaaagccctgctgaacaatagtgggccccgctacaagcgcagccagcttgaaaggcagatgaactgcgatgtcctctggtgtgtccttctcctcgtttgtatatctctattttcagcggttgggcatggattgtgggttcggcgctatcaagagaaaaaagcactatttgatgttcccgagtctgatggcagctctttatccccagccacagctgcagtttactcattttttacaatgataatagttctgcaggttttgattccaatttccttatatgtttccattgaaattgttaaagtgtgccaagtatacttcattaaccaagatatagagctctatgatgaagagacagattcacagctgcagtgccgagctctgaacataacagaagacttagggcagataaaatacatcttctcggacaaaaccggcacattaactgagaacaagatggtctttcgaagatgcactgtgtccggcatagaatattctcacgatgccaatgctcagcgactggccaggtatcaagaggcagactcagaagaggaggaagtggtgtccaaggtgggcacaatatcccaccgtggcagcactgggagccatcagagcatctggatgactcataagacccaaagtatcaagtcccaccggcgcacaggcagtcgggctgaggccaagagagccagcatgctgtctaagcacactgccttcagcagccccatggagaaagacattacacctgaccccaagctgttggagaaggtgagtgagtgtgaccgattcctcgccattgcaaggcaccaggaacaccctctggcccatctctcacccgagctgtctgatgtttttgatttcttcatcgcactcaccatctgcaatacagtagttgtcacctctccagaccaaccacgacaaaaggtgagggtgaggtttgagctgaagtccccagtaaagaccatagaagatttccttcggaggttcacgcccagccgcctggcttctggctgcagcagtatcgggaacctgagcaccagtaaatccagccacaaatctggatcagcttttctgcccagcctgtctcaggacagcatgcttcttgggctggaggagaagctaggtcaaacagcaccgtccattgccagcaatggctatgccagccaggcaggccaggaggaaagctgggcctcagattgtactacagaccagaagtgtccaggggagcagagggagcagcaggagggggagctgcgatatgaggctgagagcccagatgaggctgcactggtgtatgcagccagagcctataactgtgccctggtggaccggcttcacgaccaggtgtctgtggagttgccacacctaggcaggctcactttcgagctgctgcacacacttggcttcgactccatccgcaagaggatgtcagtggtgatccgccacccgctgactgacgagatcaatgtatacaccaagggggccgattcagtggtcatggatcttctgctgccctgttcctcagatgacgccagaggaaggcaccagaaaaagatccggagtaaaacacagaattacctcaatctttatgcagtagaaggcctgcgcaccctgtgcattgccaagagggttctgagcaaagaagagtatgcctgctggttgcagagccacatagaagccgaggcgtctgtggagagccgtgaggagctcctcttccagtctgccgttcgcctggagacgaacttgcacctgctgggtgccacggggatagaagaccgccttcaggaaggagtacctgaaaccattgccaaattacgacaagctggcctgcagatttgggttctcacaggtgacaaacaggaaacagccattaacattgcatatgcctgcaaacttctggatcatggtgaagaggtcatcacactgaatgctgactctcaggaagcatgtgcagccctgctggaccagtgcctcagttatgtgcaatccagaaaccctagaagtacccttcagaactctgaaagcaacttgagtgtggggttctctttcaacccagtctccacatccactgacgccagccccagcccaagccttgtgattgatggaagaagtctggcctatgccctcgagaaaagcctggaggacaaatttcttttccttgccaagcagtgtcgctcagtcctctgctgccgatcgacccctttgcaaaagagcatggtggtgaagcttgtcagaagcaagctcaaggccatgaccttggccataggtgatggggccaatgatgtcagcatgatccaggtggcagatgtaggtgttgggatctcaggccaggagggcatgcaggctgtgatggcaagtgactttgcagtgccaagattccgatacctggagagacttttgatcgtccatggacactggtgctactccagactggccaatatggtgctgtatttcttctataaaaacacaatgtctgtgggtctcttgttttggttccagttttactgtggcttttctgcatctgccatgattgatcagtggtatctgattttctttaatctgctcttctcatcacttccccagctggtgactggggtgctggataaagatgttccagctgacatgctgctgagagagccacagctttacaagagtggccaaaacatggaggaatacagaccacgagcattctggttaaacatggtggatgctgcctttcaaagcctggtatgctttttcattccctacctggcctactatgactccgatgtggatgtctttacctgggggacccctgtcacagcaatagcactgttcaccttcctgctgcacctgggtattgaaaccaaaacctggacctggctcaactggttagcctgtggcttcagtacctttttgtttttctccgtggctctgatttacaacacttcctgtgccacatgctaccctccatctaacccttactggaccatgcagacattactgggtgaccctctgttctacttgacttgtctcatcgcacctattgctgcattgttgcccagattgtttttcaaagccctccaggggagtcttttccccacccaactccagctaggacgccagttggccaagaaacccctcaacaaattcagtgatcccaaagagacttttgctcagggacaaccacctggacactcagaaaccgagctttcagaaaggaagaccatgggaccttttgagactctccctagagactgtgcctctcaagcttcccagttcacacagcagctgacctgttccccagaagccagtggggaacccagtgcagtggatacaaacatgccattaagagagaacaccttgctggaaggacttggctctcaggcctcagggtcctccatgcccagaggggctatttcagaagtatgtcctggggattctaagagacaatccagcagtgctagtcagactgcccgtttgtcgtcactcttccatctgcccagctttggctccctaaattggatctcttcgctgtcactggccagtgggctgggaagtgtcttgcaattgtctggaagtagtttacagatggataagcaggatggtgagtttctatccaacccaccacagccagagcaggacctgcacagcttccagggacaagtcacgggctacttatagtatcacctccgaagggccacagccaaatgtggtgacaaagaaatccttgaaatg

SEQ ID NO: 591 - DNA, 958 bp, Mus musculus
ctgaaccgagcctggtgccgcgcagtcagctcagccccatgtggcggctccctcccggtcttcctcctacgagcagcatgaaagccttcagtccggtgaggtccgttaggaaaaacagcctgtcggaccacagcttgggcatctcccggagcaaaaccccggtggacgacccgatgagtctgctctacaacatgaacgactgctactccaagctcaaggaactggtgcccagcatcccccagaacaagaaggtgaccaagatggaaatcctgcagcacgtcatcgattacatcttggacctgcagatcgccctggactcgcatcccactatcgtcagcctgcatcaccagagacctggacagaaccaggcgtccaggacgccgctgaccaccctgaacacggacatcagcatcctgtccttgcaggtgagactagcttgcaagtacgccactgcccagacgctccgggtctcccgagctgtcactcttaaagcccatcgtagagacaggttcattaactttatttttgaggaaactgtatattgagcgtcatgtgaaatcgctacttataagttctgtgtgggttgcatctggatctgcgctgtagcatgatcctgtttcatgggacttgttggcacttttgtgaaaggaggaggggggctaccttcctttaagattacctaatatcctgccttttatcctctttctccccaggcatctgaattcccttctgagcttatgtcgaatgatagcaaagtactctgtggctaaataaatggtgagtgttgcgggtgcctcctgtgtgcgcgtttcggtaatgtgcttgtgtgtctgttaaatgtttggtttggtaaatgcatgcttacttcactgtgttacgggtgccgcttgacttaccacataggcatgaaggggcttgtagctgtggttgctcaggactacagaacagttgcctttac

SEQ ID NO: 592 - DNA, 819 bp, Mus musculus
cccacgcgtccgcggcattctgagcaggaatggcagtgtggacctctgtgatgggacatcttgtgggatctcacagccagttctgtggcaaaggaggatgaaggcttacgaggactcgtcaggaagctggataacagagcgagcgcaatgtaagcaattttgtgtgtgcatgtggtcccattacaaggaatacccaatggcaaatgagcactaaagatccctcaacccacacattgaatgtattgttccctgagagcaattgtagatagaggagtgggtgggaagtctgaagtcagggcattgtttctgcgtatctgaggaggctggtttttgatatgtgggagctagtggtcgttaacgcatttaccccctatttggtggactctggttcccccatcttaagtgctgagtcaggggcctaaccgggcagctttaactatttgtttgttgtaggtgctagaatagaagaccagaaaatgaaatggtggagtttgaggctggatagacagtttgaaagttaactggttgcatgcttgttcatttggctggcttgcttgggtacaaataatggtttgaataaagaaaggtattaatgggtcacctcaagtgaaggcactgcaaacacaatgattggtcattctgaatttccggtccttcattctgaatttcaaaggctcctgtgacaagtggacatgcagtgactgcacctttgtttctgaggtgcctggatggaggctcaaatagaagatggtgtcagatatattgtgttaaaattttaccattaaagtgtattataacatgaaaaaaaaaaaaaaaaaa

SEQ ID NO: 593 - DNA, 493 bp, Mus musculus
ctcccattaaaaacttggggaatgctattttgaaaagaattacagtggcatatccaaacatttctaagtggactttaggctgcccttccttcctctgcatgggccacaggaggggagggggaggggctgctgtgtgacagggccgggtggccgcctcctcccagcagctactctacagctgaaaacaggagaaaacaagacagcattagaaatcagtcgagagccactccctgctcactgacagctaaagctcttgttctgggagtgcgcgagcacattagttggcagaggaggcctgcatgtgtgttaggggatggggctccaagtgtccacaaagccccatacagtgtaagagaagctgcgttctggcccaaagagaaagaaaggcagaaggttgggtgggcatgcgggcagccattcccaggtttgtgtgctgtcttgtttctaagcccctgaatttgcattgaagaatcactgactaacagaattttgc

SEQ ID NO: 594 - DNA, 282 bp, Mus musculus
atgaagacactagtcctcctctctgccctcgtcctgctggccttccaggtccaggctgatcctatccaaaacacagatgaagagactaaaactgaggagcagccaggggaagacgaccaggctgtgtctgtctcttttggagacccagaaggctcttctcttcaagaggaatcgttgagagatctggtatgctattgtagaaaaagaggctgcaaaagaagagaacgcatgaatgggacctgcagaaagggtcatttaatgtacacactctgctgtcgctga

SEQ ID NO: 595 - DNA, 497 bp, Mus musculus
cacatttttaaaaatatttttattaaataacctacttggaggataattacaaaatccttaagtattaattcccagtagtgaaaggcattttcctttaaaaaaagaaaaaaaagacaaaaatatccttatgatttgctgctttatacacaggaatgatttattttacagtcatctgtaacatcagcgtataaaattcaaaacatttcttaatgtctgaagtccagagtgaagttcacaatgatacgctctcctatgaagctacctatcaacagacaaacctgaactctatggtaacaactccacacagaatttacaaggcaggcactttgaatcagatactgggaatctttcacagttaatattgctttttctgaagctcctctcatcaaaggtaaccaactagtgaagccaaggcttccttgtgcagaagtacaaaaaaaggtttggtttcaaacacttgagttgtgatacatgcaagacatgccctaaataagaag

SEQ ID NO: 596 - DNA, 652 bp, Mus musculus
tttttttttttttttttttttttttttaaacgtaattcttggaagacgaggaagtcatgcacattttgcttgaaatttaaccagtaaaagtaagttggatggggattagccagtcttcgattggatcattattattttatttgggaatattaagatttgtttaaatttttaatgatctacatttagcagccagtagtagaaatgtattttgtgagttttcccccactttgtttttttgattgtaaattgcctgagggcttaagttttattgcctttcacagaatggcgtaaatacaggggaaatggttttccttaaaaccatctttttagagctgcctttctggtgagtactgctttataatttttgtatcacagttttatttttttaagctacctggaaggtgacagtgattgaaatgagcattttttaaaacttggatcaaaaccttaaaatgacagttactgcctgataattccctatgtttcctatttaaaattttttttttttccccttacttttcctaaaggtaccgtattgcaccttaaacatttgaaccccgaatttatttctcttttgggggagggaaaaaaaaaatgtgggtaatatttttttaaaatttttaaaaaatttgtttaaaaaacggggggaatt

SEQ ID NO: 597 - DNA, 307 bp, Mus musculus
acggtgccccctcctcagccccccctgaacccctagtctgccccacctactctgagcataggaaacgtgtctccccgtgtatatgtatgtatgccatgttatttatttcaaagagtttagctgctctctggtgtgcctccagattctccacaggctcgccctttctggcttggctgtgtacttgcctggaagacgggttttttgttaagttttttcctctcattgatgggggctgagaccagtttgtccaaccttgacacaacaggtaaagacaggtgaaaagaaataaaaacgtttttatgttctc

SEQ ID NO: 598 - DNA, 608 bp, Mus musculus
cctttttctttaatagggatttcatttttatatttttaaagaaaaacaacccaaagctacattgtggaaaaaaaatctgcatgaaataaaaagctccataagcctacacagcaattcttcctgctgtgtcaggctgcttcggacagcgctctctgacctccaggttaagccgagtgcagctgctctctaagtggataatgacatagtccttccctctgggaacgggccacaattagagccactctgtagaccagaataaggccgtcataaggaacgcctgtattctatatatctcattacacactgtgcccaagggtctaataatacaacatccaacaatcaattgccaaatgaatgagtgaatgcttgcgatcggcccatgcatttttaacacacaaatatcacatggccgtgctttaagataatcaaagttttgataaattattatgcaatttctaagttgaaagtttctatcctttctcttcttgctttattatttggatgggaaacctaagtaccaaggtgtgggaagctttaaatgtcccaagcatcaaattgagaactgtaggtgtgaacagagataaagtttgtagctctgggaagttttg

SEQ ID NO: 599 - DNA, 580 bp, Mus musculus
  modified_base (371)..(371): a, c, g, t, unknown or other
  modified_base (393)..(393): a, c, g, t, unknown or other
  modified_base (401)..(401): a, c, g, t, unknown or other
  modified_base (409)..(409): a, c, g, t, unknown or other
  modified_base (411)..(411): a, c, g, t, unknown or other
  modified_base (414)..(414): a, c, g, t, unknown or other
  modified_base (422)..(422): a, c, g, t, unknown or other
  modified_base (443)..(443): a, c, g, t, unknown or other
  modified_base (458)..(458): a, c, g, t, unknown or other
  modified_base (483)..(483): a, c, g, t, unknown or other
  modified_base (512)..(512): a, c, g, t, unknown or other
  modified_base (521)..(521): a, c, g, t, unknown or other
  modified_base (524)..(524): a, c, g, t, unknown or other
  modified_base (546)..(546): a, c, g, t, unknown or other
  modified_base (553)..(553): a, c, g, t, unknown or other
  modified_base (557)..(557): a, c, g, t, unknown or other
ggacatggtactctttattgtgacgctcagtggaaacatctgtaaaccagcttactgtagtggtgacagctgcgacacatgctaaggcacttgtattatataaaaaaaggggtgcgggtcccacttgctcctttatgacagcgcctttgggacctggattcagcttctctagcgtatgtggcttcatgatttgactggttttcctttaaaaaaaaaaaaaagaaaagaaaaaaaaaagaaaaaaaaagccttcctgccataaggggacctaatcacagcatttacaaacagtgaggtgcagtgcgcagggaactcagcgaccagtgtagacattgtaggggcaaactactctctttctaaaacacagtttncaggggccaagggccgttaagnaaaccccngaaacttngngcncttattancaagaagggaaaaattaaaancctttttttttcttntcaaaagcatcccttgtgggaaggnagacttgaaagctttagattgggtggcanagcttcganaancctttggccccagttcctaggngagggcnccanagcggcccaatggggctccagcc

SEQ ID NO: 600 - DNA, 676 bp, Mus musculus
agtaatcactgtacatttattattttaattaaggaaaccataaagaatacaaaattacaataatcatgtgcccttttacatataatgacattaaagcaaaactctaagccagtttgtaaagtattcaatttacctcaagtccaagctgcatctccctaagacactgttcccatcacagtagccattttaagccaatcttcttttaacacacgggtagtttctgtagagaacacttttctcaggacgaaaatgcatcgagcatgcataagaaaatatatatatactcgcaaatacattaaagagtttctttaggatatttactgaagaaaacaaaacccagggatttatttgcttctttaaagcaccaattaaattaaaaaatccctcaattaaatttgtagtaaaagttgattgactgattaaataaaaaagcagttattttcagtcaaattatttctaagtattatgaaaatgcattttaaagccaggcagaatttgcagaactaaaatgagattatctccagcgagttaattctacatcaatttactagacatgtaactattttcaggaagaactggttgtaatgacaaagtattgaagtgaacaaaaactttctctatcgagagcacttgctactcctatctaaacccactttatcaattaagtaccaagatc

SEQ ID NO: 601 - DNA, 437 bp, Mus musculus
atctacctccagtgtaaatttaatatgttcagttctttcatggtcagagaagaaacattcttaacagcttaggtttcactttatttgtgcacatatagagacaaatgcatatgtacatatacataaacagtgtctttcttactaaactttttcctgagggagtgggaatgatgctgtgttttggttacacattataaacagtacaaataaacaaaagatggtctttcccaagctcctccctcatgttaacccccttaaaaacatctgaagaatacagttgttcgcttattttttattttaaaaggtagtttggtgatctagagtaaatgaaaacttcattattgagagatagaataaatctttagaagtgtattagtgaaagaatcttataaatgtgttacttcataaaacatctaacactgtagacatgttctagt

SEQ ID NO: 602 - DNA, 414 bp, Mus musculus
atcgcgaccccccccagcacgcaactcctccccccccccccccccactattccctttttttttacttcccccgtagaagcaagaagacgaagggaatctcatcctttaataagtgtcccaacaagaagcacaggctgtccccctcctgcggatccaaggcctaccaccttcagaatttgacttttggcaagtgtggctaccctgccaagcgcaagaggaagtataactggagtgccaaggctaagagacgaaacactaccgggactggtcggatgaggcacctaaagattttttaccgcagattcagacatggattccgtgagggaacaacgccgaaacccaagagggcagctgtcgcagcatccagtttttcttaaggatttcaatcagtcataaaataaatgttctgcttcc

SEQ ID NO: 603 - DNA, 715 bp, Mus musculus
cccacttaaaaaaaatttttttattaagaaatagcatatacacaaaagcacacaaacatacagttcaaaaagaaaaaagcccatcgagttagagaaaacgcggtggccattactctgaaacccaccctgccctccaaggtcattctcaagcagccgctaagagtgatctgtatgccgactgtctgtctctctgtcatttaccgtgtactcttaacagcctgttttgacctttaccaaagggaagcataatggaaaactccttctgtggcttgatttctggggacattattaagtcgtggtcatccaggtcacatgtggagctgaagttcatcttcacgcctgtggaattccacggtggggatgggtcacgctagttatccacacaaatgctggtgggatccgcccagggttttgctggtttgggttttctcttcttcattacacaagatgacattaagatatttgttcatccttctcctggcagcatgtaagagtttttcgagtatgtacctagggctgacacttaactgtgctgaaccgtttccaaagttgcccctaaacaaacctgttgacagataactgatctacttgagatggccgagggaaagaaatagatcaactgtgaaactcgggaaatgcatgttaatagaaaatccatcattctgacacatgaaaatgccatttaccctgtttcagcttacttgaaatgtacttt

SEQ ID NO: 604 - DNA, 501 bp, Mus musculus
tttaacctcttcccctgcaagagaattgtacagtttcatttgaactgggatttgaagagcagttgtacttgaccatgactgattggctgacttcataaagtgtatgacttgacttccaatagctaattggctcttagggtaatgtgatgtctttaatggataaaacctttgcaaagctgtatttttaagactcaaattggaaaattactgagccacagtagcattctctgacctccttcaacccatggaaagtattaatctacatagaaggtagaaagggaattgaaaaattcattcattgtttttttaactatggctttttagaatgttaagtaagcagtaacttgacttttgtttgtgtgtgtttcattgtttcctatagagtaccttctactttgaaaattaaattttgtgggtaaattaaattaaaagtacttgtggggctgatgacattttctggtcatttccttctgacctgtttttctgtcgcctgccttcagt

SEQ ID NO: 605 - DNA, 7693 bp, Mus musculus
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaacgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccaggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgcccgtgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttttactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatgtgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgcctacggggcacctgccaggacccggacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacagcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaacgagtgtgaatccaacccttgtgtcaacggcggcacctgcaaagacatgaccagtggcatcgtgtgcacctgccgggagggcttcagcggtcccaactgccagaccaacatcaacgagtgtgcgtccaacccatgtctgaacaagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacggctggggccaaagggcagacctgtgaggtcgacatcaacgagtgcgttctgagcccgtgccggcacggcgcatcctgccagaacacccacggcgsstaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgtagtcaatgagtgcgactcacgaccctgcctgctaggcggcacctgtcaggacggtcgcggtctccacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggatggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctgaccccttcgccggagtcgcccgaccaatggtcgtcctcgtcgccgcactctaatgtgtctgactggtctgagggcgtgtcgtcgcccccgacctccatgcagtcccagatcgcgcgcatcccggaggcgttcaagtaatagctcgaggtgccagcagctc

SEQ ID NO: 606 - DNA, 498 bp, Mus musculus
cagcttctttttttttttttttcatgaactaaagctttattacgattccttttttttgatccctttgcacccctgcacctaagccaaaagcattataatcttgtcatacttcagataagtccacgggagatgttccgagtgaactatagatgacattccactagggaattctatgttcagtgtaaatggtatcttgtataagttttagttttttgtctaccctttgtttcctgggctgagcttgtccagaaatcttgtcttcttcaggctacagcagcttagagcttgcttgtgtgtgtgtttgtttgtttgtcttaaaggtataggcaaaattttagtcttaacacctgtaaaccagtactggtgttgttctgtcctagaaattttagcactgctctgatacaataaagccttctttctctccaactggttcaacttcagcataggcaggatgtccagagcctcttctaaacttcatcgcaggccatctgcttgggc

SEQ ID NO: 607 - DNA, 538 bp, Mus musculus
  modified_base (147)..(147): a, c, g, t, unknown or other
  modified_base (217)..(217): a, c, g, t, unknown or other
  modified_base (296)..(296): a, c, g, t, unknown or other
  modified_base (398)..(398): a, c, g, t, unknown or other
  modified_base (489)..(489): a, c, g, t, unknown or other
  modified_base (497)..(497): a, c, g, t, unknown or other
  modified_base (499)..(499): a, c, g, t, unknown or other
  modified_base (514)..(515): a, c, g, t, unknown or other
  modified_base (532)..(532): a, c, g, t, unknown or other
  modified_base (537)..(537): a, c, g, t, unknown or other
caggatgtgacaacgtttttaatgcaaagtcaaccattagcatctttcccatgtacttattagatgtgaaatggcaggacttcacggccccgtttgcatattttcctactccgcagacgaataatattttcagggaaggcagcgcantctgtgccgtcacaatcgggcgactgtgggtgatgagggatgatgattttccaggaggccctggggtcanaggactcctagagggagtttccagcccctcaatcgcagatggatggcctgttgatgttgtaactggggtggaagttganccggtcacaggaggtgatgcagttatcggggccagtcacgatgcttttctccaggtaaacattgagagtattgttccggaacattccacccgaggcatctcntgcacggtgggggctctgctcccgtaagcctggttactgggtcctgtcactgaaacagccttctgggtccttgtaacccccgaaccacccngggttggntnaaccttgcccggcanngtccgcgcttacgccgnaagtna

SEQ ID NO: 608 - DNA, 3160 bp, Mus musculus
ataatactgatgaagcatttttgttccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccagggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttaaaaaaaaaaaaaaaaaa

SEQ ID NO: 609 - DNA, 2487 bp, Mus musculus
ctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccacacgtgtgccggcccatcaccgtggccttgctgatgcgcctcctgcagcagctgacgggcatcacgcccatcctggtctacctgcagtccatcttcgacagcaccgctgtcctgctgccccccaaggacgacgcagccatcgttggggccgtgcggctcctgtccgtgctgatcgccgccctcaccatggacctcgcaggccgcaaggtgctgctcttcgtctcagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcatggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgt

SEQ ID NO: 610 - DNA, 1475 bp, Mus musculus
cctggagttccggccaggccactgcttgggaagcaagaaggtgaaggcacctctgctgggccaagcactcttagggccgaggggcactgcagctgacaagagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaattgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcagggaaggtccagacagtcctgccactcctgtttaccgtcaacgtctatctgtatctgtaggtcaggaggacaaacataggtcaataaatatgtaatgttagtgaacg

SEQ ID NO: 611 - DNA, 3381 bp, Mus musculus
gccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctacatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttaaaaaaaaaaaaaaaaaaa

SEQ ID NO: 612 - DNA, 2312 bp, Mus musculus
aagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgccaaaaaaaaaaaaaaaaa

SEQ ID NO: 613 - DNA, 1431 bp, Mus musculus
atggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctgggggcagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactag

SEQ ID NO: 614 - DNA, 2804 bp, Mus musculus
atttttattaagcagtcttagcccaaaggcagcatccttccttgctagagagaaagggcactttggtccctggaaagacagaggcaagcagcagcatcggagacactgctcccagtcaggactcaaagtcagcgacagaagtgtttctgagtggattaggaaaggtaacctcatcgtttatatgcacttgtctggtcaggcaatattttgactttgctggcagagattctgtccaaacacctgctcttcttcatacatcttctagaggtgctggccagacatggctccaggtcactggaaatgagctgctgcatgttgagtatctgcagtcctgtagcaagggcagacttggcactcatgggctgatgttgccgcagctgcccctgctcccacaccacaggttacatgatcccttgtcctgtccatggtctttggcagggtcacagggcagagggaagggtcagagagaagtgacatcttgaagggctggtgcctgggtaagaaaggttgcccatctggcatcccatttcaattgggttttctgcttgttaaatgaggcccctaagtcctaacctgccaatcacaggagctaaggcaaggttccgctttggggaaatctaccttttaagagacttcttgttcagaagtcttcaggaaatgaggctctgatggtagaatgccataaactgtgttaactgatgaaggggaaagtttagttgggaagtgaggagaaccacccaatgctttaaccatgaagccagctcagccaaagtgctgggcagtcgtgggcttttctatgctttgtttccccattagtagcctttgaaaatctatgcaattgaggggaagtaaaggcaggaaggactacctacccaggcagagcagtcttgccatccccaaacacctgtggtctccaggagtctccttgataggagagccccctggtaggggcacttgctttagctttcacaatttattaggaaatggggctcaggatgggtgggcaactgtggtgaggcagggggagatgaaaacaggcatgttccattgatgagctcatattatcagtgggctcaaccatccatcatcagtgttgctcttccaaacagcactgtgcccacctggcagcaaagcgacttttggtttcaaaataattgagcacaggattttatggaatgtgcttaggggtcagttatgagttgtctcccagatgggtgagatcctgagaattttcaggctaatggagagtcctcatcctgtctgagcaatttcccctcagaattggttatcttcaatatactggactgtgctgtttctacacatcccagtgggtgggtttagaagatgactatttgccccctaaatgtggtcaatgggatagcaggaagacaaagaatgccatcctcagccccaaatataattcctgggttctgactcacaggtgttcatcagaacagacaccatggcagagcatgattaccatgaagactatgggttcagcagtttcaatgacagcagccaggaggagcatcaagccttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaaaagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgaaaaactgctctggaatttgcaaggcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactgggg

SEQ ID NO: 615 - DNA, 1101 bp, Mus musculus
ggggggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggagttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctataatcccagcactttgggaggccaaagcaggtggatcacttgaggtcaggagttcgagaccagcctggccaacatggtgaaactctgtgtctactaaaaatacaaaaaaaaaaaaaaaaaaaaaaaaaaaaaa

SEQ ID NO: 616 - DNA, 955 bp, Mus musculus
tgtagccagctcggctcccttccctgtgtatctgtgtcctgctaacagccaagagatgttgcaagggaggaaaatgtgagagaccttggaacctgtcaggtttattgtttcgtttttaaaggcatgtttgaagtttagttctttacccttctcctaaaatctttttttaatcagcctcaaggttaaaataaggagtgactacagtatgtaaaataaggaaaggaagcattaatggtgtgatgtgacctgcctgtttttttgtaaacaagagaataggaaatgttttcaaggtagtttcacatgtcttgcaccaagctcatgcctcttgcttttcctttttgactttatctccctcagtttttcttctgctgtggccagaaagacagtcactacagttgactattgatacaaaggtgcaacagaaatattatccctgcatttttaaatataagaagtagacattaatctttaaccatggtgcctccctaatgtaagtgatatttcattggtggtttcaacaaaggttaagctcattacagacagaaatattcgtctttatcttccttttcccctgcctcagtcgtgttattcacccctattcttgatatttcaaaggaggagaatcagtagcattttccttatattatacacatgtgtctatcccatttcaggtcaagtcttacacccaactcatggcttccagtaggaaaataagacattctgccttagtgttaaatgcaagatagggcttctcttccggatgaggactggttgttctactctagtctgggactaacatccgactgggctacttaattaaggacgacagaagtgctccaatttaaaacgtgtccaggataagagatcacaaaaggttggtcagaataggcttttcacatagacatcgaggtcccaacggggggaattaaacataggtatctgatgttatcataga

SEQ ID NO: 617 - DNA, 1218 bp, Mus musculus
acacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaaaaaaaaaaaaaaaaaaaaaaa

SEQ ID NO: 618 - DNA, 2272 bp, Mus musculus
gaagcgactctgagtcccgggctcggagcgcaggctcagctccgcgctgcgagcgctacgggcgcaggggcggggagccggcccggagcgcagtttccagtggggccggggtttcacccgggccctctctgtttgaaccgaacccgacaaatgggcgcatgacgatggagagcagggaaatggactgctatctccgtcgcctcaaacaggagctgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgccagaactggagaagggtggggagaagggtgagactgggggggcacgtgaacccaaaggagagaaaggccagccccaggagctgggccgcaggttcgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacagaaagttgactgagcctgaaagggccaggtcccagtgctgggcccctggggaggagggagggtgggcggtatggctctcgaaagcccaactccaagttcctttcccccagaaagcggggagaagccagagttcttggctcaggactgaagggaaggtggttgggagaggctgtcttgggggctagctggtggaggaggtaagagtagctggagagtgagctgtgcgtgtgtgtgtgtgtgtgtgcatgtgtgtgtctgtctggcatgcatgcactcactttggggctggaggtgacagtaggtgagggcagaggaggagatcagaaaatccctctgacatctccactgcccccaaagacctccgttgaacattctgtatggaaaagagccctggagcatcaggttccccagataggcccccaaataaagacctgtctatggctctcccaaccttctgtcagcttctttggcaagacattgctccaggcacagggactgaaccccaggcctcctgggactggagcagcagtgaggcaaaacccgacctgctagccctttctgccttggaggtttcagtccatacctggactctgagaaaatgagctgaataaggagtacagtgtgtaaggagcagccagggaagccctagacactccccgcgtctcccccatgcacaggggaaggatgttgacatagcactgggctgtttgaatgccttttcatctccatggtctcatttgaaagtgagcgaggcaggcaggcatgatcccattttccagataaggaaacaagcctagatatgctacatgtccaggaacaactgcagccaggaggcagaacagcctaggtctaactgcagagtagaagctggaccctggagttaccaacactcctccccaacagttcttagcgccccgcaggctgggcgctgtggctcacgcctgtaatcccagcactttgggagggcaaggcaggcggattacctggggtcaggagttcatgaccagcctggccaacatggtgaaaccccgtctctactaaaaaaatacgtaaaaattagccaggcgtggtggcacacgcctgtaaacccagctactcgggaggctgaggcaggagaattgcttgagcccgggagagggaggttgcagtgagccgagatcatgccactgcactccagcctggctgacagagcaagactcccctgtctc

SEQ ID NO: 619 - DNA, 1729 bp, Mus musculus
tacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaa

SEQ ID NO: 620 - DNA, 1614 bp, Mus musculus
ggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccctgtagccctttgggactttgcggtcccctaagtagaaaattcctatgggcctgtctcctgggggcctctgtctgctggtggtctgcttaccacagaatcctaaggggcaggagtgcctgggcatgtgtctgtgggagccttgcagtcagttgtgtttggacaagtgcaacagtcaggctgctgattcctgtggcatgcaggctgtagaggttgacaaatggaggggggtgttgagggtgagccctagttgattttttaaaatttaaactctggtaagaacatttaatatgagacctactctctttttttctttacttatttatttatctatttatttcaagacagggtctcactctgtcacctaggctggggtgcaatggtgcaatcatggctcactgcagcctcaacctcccaggctcaagtgatcctcccacctcagcctcccaaagtgctaggattacaggcatgagtcaccgcgcctggccaagatcacctaacaaaattgtaagtgtgtacgatacttaaaatttaagagattatgtgcacggcagacctctagaactgaatagtcttgcatcttgcataattcagaacttcatcatcttgcataactgaaactttgtgcctgttaccagaaaaaaaaaaaaaaa

SEQ ID NO: 621 - DNA, 263 bp, Mus musculus
ttttttttttttttttttttttttttttttttacacactcattcaaacctttattaagtacctaccatatgtacaatactgttccaaatattaagggaatacaaagatgaatttttaaatggggccaaatcccaaggggtttacaatataataatagtaaaaagtaatttaacacgaactgtgggaagaaaattacaagtaaacatttgcccctgatggagaaaaatgaccttatttttaaatttaaagcataaattgccagt

SEQ ID NO: 622 - DNA, 724 bp, Mus musculus
  modified_base (570)..(570): a, c, g, t, unknown or other
  modified_base (595)..(595): a, c, g, t, unknown or other
  modified_base (634)..(634): a, c, g, t, unknown or other
  modified_base (637)..(637): a, c, g, t, unknown or other
aaaccttaacccagagttatttttattttccagaacgtgttaggaactagtacttaaataatctcaagtccctgaggggccagagatcccaccatgcaaaatagcaaacagacccaagacttggggagaggcggtgagtgcatcagaaatggatgggtacatctgattcccaccacgcggggctcagcttagttagcaggagaccttcagactgagaaaaaatgcaagtctttttttggcctctaatatctgggaaggatggagggagctcaggagacacagaaaagatggcgtatgaatcctgtccggcctgaacgaggctggagttgtgcctctggatagcttcaagcactgatcagattgtcagcccccgctgcttgaacagatgctttagagcctcttccagttgccggtttgttccctgaagccccttcaccacctgcgctgcccactcgaagtattcctggactcgatgttctgaccatccctctggggtgcagcgattcaggtccctcagattgtacagcttgtctgccagcttcaccagtttggccccggggctactgtggngcgcttggctcacctgcagcctctntctctccagcttgggcagagtcttgtcatctggtacctnctncaccaggcgccgcacttgtgccccaaagtgtagcttcaccctcatccaggtggtgtctgtgtcctccaccgtgtcatggagcagggc

SEQ ID NO: 623 - DNA, 3678 bp, Mus musculus
cggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaaagagagaaagttaaaaaaaaaaaaaaaaaa

SEQ ID NO: 624 - DNA, 2487 bp, Mus musculus; identical to SEQ ID NO: 609

We claim:

1. A method for identifying a cell exhibiting asymmetric self-renewal comprising measuring the expression level of at least 20 nucleic acid sequences, or measuring the expression level of a mammalian homologue of each of the 20 nucleic acid sequences, wherein the 20 nucleic acid sequences are identified by the following SEQ ID NOs: SEQ ID NO: 231, SEQ ID NO: 298, SEQ ID NO:303, SEQ ID NO: 338, SEQ ID NO: 275, SEQ ID NO: 261, SEQ ID NO: 339, SEQ ID NO: 262, SEQ ID NO: 254, SEQ ID NO: 255, SEQ ID NO: 288, SEQ ID NO: 219, SEQ ID NO: 243, SEQ ID NO: 216, SEQ ID NO: 221, SEQ ID NO: 297, SEQ ID NO: 250, SEQ ID NO: 237, SEQ ID NO: 232, SEQ ID NO: 218; and
wherein an increase in expression level relative to isogenic cells not undergoing asymmetric replication of said nucleic acids is indicative of a cell exhibiting asymmetric self-renewal.

2. The method of claim 1, further comprising measuring the expression level of at least 18 additional nucleic acid sequences, or measuring the expression level of a mammalian homologue of each of the 18 nucleic acid sequences, wherein the 18 nucleic acid sequences are identified by the following SEQ ID NOs:
SEQ ID NO: 242, SEQ ID NO: 247, SEQ ID NO: 387, SEQ ID NO: 224, SEQ ID NO: 355, SEQ ID NO: 402, SEQ ID NO: 266, SEQ ID NO: 327, SEQ ID NO: 391, SEQ ID NO: 238, SEQ ID NO: 334, SEQ ID NO: 271, SEQ ID NO: 263, SEQ ID NO: 310, SEQ ID NO: 352, SEQ ID NO: 358, SEQ ID NO: 267, SEQ ID NO: 365;
and wherein an increase in expression level relative to isogenic cells not undergoing asymmetric replication of said nucleic acids is indicative of a cell exhibiting asymmetric self-renewal.

3. The method of claim 1, wherein the mammalian homologue is a human homologue.

4. The method of claim 1, wherein an at least 50 fold increase in expression level relative to isogenic cells not undergoing asymmetric replication of said nucleic acids is indicative of a cell exhibiting asymmetric self-renewal.

5. The method of claim 1, wherein an at least 100 fold increase in expression level relative to isogenic cells not undergoing asymmetric replication of said nucleic acids is indicative of a cell exhibiting asymmetric self-renewal.

6. The method of claim 1, wherein the cell is in a population of cells.

7. The method of claim 1, wherein the nucleic acid sequences are amplified.

8. The method of claim 1, wherein said expression level is measured using a method selected from the group consisting of: Northern-blot hybridization, ribonuclease protection assay, reverse transcriptase polymerase chain reaction (RT-PCR), competitive polymerase chain reaction, ion-pair high-performance liquid chromatography, real-time RT-PCR, and nucleic acid array analysis.

9. The method of claim 1, wherein the expression level is measured using a fluorescent signal.

10. The method of claim 1, wherein the expression level is determined by measuring the expression level of a protein encoded by the nucleic acid sequence or corresponding human homolog.

11. The method of claim 1, wherein the expression level is measured using a fluorescent signal.

12. The method of claim 1, wherein the cell is a somatic stem cell.

13. The method of claim 1, further comprising measuring the expression level of at least 6 additional nucleic acid sequences, or measuring the expression level of a mammalian homologue of each of the 6 nucleic acid sequences, wherein the 18 nucleic acid sequences are identified by the following SEQ ID NOs: SEQ ID NO: 6, SEQ ID NO: 16, SEQ ID NO: 24, SEQ ID NO: 26, SEQ ID NO: 70, and SEQ ID NO: 83, and wherein an increase in expression level relative to isogenic cells not undergoing asymmetric replication of said nucleic acids is indicative of a cell exhibiting asymmetric self-renewal.

* * * * *

UNITED STATES PATENT AND TRADEMARK OFFICE
CERTIFICATE OF CORRECTION

PATENT NO. : 7,867,712 B2  Page 1 of 1
APPLICATION NO. : 12/063182
DATED : January 11, 2011
INVENTOR(S) : James L. Sherley et al.

It is certified that error appears in the above-identified patent and that said Letters Patent is hereby corrected as shown below:

Please delete the paragraph titled 'GOVERNMENT SUPPORT' encompassing Column 1, lines 14-17:

"This invention was made with Government support under PSO HG 003170-02 awarded by the N.I.H.-N.H.G.R.I. and N.I.H.-N.I.E.H.S.C.E.H.S pilot grant. The Government has certain rights in the invention."

and replace with:

--This invention was made with government support under Grant Nos. P50 HG003170 and P30 ES002109 awarded by the National Institutes of Health. The government has certain rights in this invention.--

Signed and Sealed this
Twenty-third Day of October, 2012

David J. Kappos
*Director of the United States Patent and Trademark Office*